(12) United States Patent
Bavari et al.

(10) Patent No.: US 7,759,320 B2
(45) Date of Patent: Jul. 20, 2010

(54) COMPOSITIONS AND METHODS FOR INHIBITING EXPRESSION OF A GENE FROM THE EBOLA

(75) Inventors: Sina Bavari, Frederick, MD (US); Kelly Lyn Warfield, Adamstown, MD (US); Pamela Tan, Kulmbach (DE); Anna Borodovsky, Cambridge, MA (US); Tatiana Novobrantseva, Wellesley, MA (US); Antonin de Fougerolles, Brookline, MA (US)

(73) Assignee: Alnylam Pharmaceuticals, Inc., Cambridge, MA (US)

( * ) Notice: Subject to any disclaimer, the term of this patent is extended or adjusted under 35 U.S.C. 154(b) by 84 days.

(21) Appl. No.: 12/055,295

(22) Filed: Mar. 25, 2008

(65) Prior Publication Data

US 2009/0143323 A1   Jun. 4, 2009

Related U.S. Application Data

(60) Provisional application No. 60/908,793, filed on Mar. 29, 2007.

(51) Int. Cl.
*C07H 21/02* (2006.01)
*C07H 21/04* (2006.01)
*A61K 31/70* (2006.01)

(52) U.S. Cl. ................... 514/44; 536/23.1; 536/24.3; 536/24.33; 536/24.5

(58) Field of Classification Search ............. 536/23.4, 536/24.3, 24.33, 24.5; 514/44
See application file for complete search history.

(56) References Cited

U.S. PATENT DOCUMENTS 5,624,803 A   4/1997   Noonberg et al.

2005/0058982 A1   3/2005   Han et al.

FOREIGN PATENT DOCUMENTS

WO   WO 2007/048046 A   4/2007

OTHER PUBLICATIONS

Geisbert et al. (J Infect Dis. Jun. 15, 2006;193(12):1650-7. Epub May 10, 2006).*
Enterlein, S., et al., "Antiviral strategies against Nipah and Ebola virus: exploring gene silencing mechanisms to identify potential antiviral targets" Antiviral Research, Elsevier Science BV., May 1, 2006, p. A38, vol. 70, No. 1.
Geisbert T.W., et al., "Postexposure protection of guinea pigs against a lethal Ebola Virus challenge is conferred by RNA interference" Journal of Infectious Diseases, Jun. 15, 2006, pp. 1650-1657, vol. 193, No. 12.
Morris, K.V., et al., "Lentiviral-mediated delivery of siRNAs for antiviral therapy," Gene Therapy, 2006, pp. 553-558, vol. 13.
PCT International Search Report and Written Opinion, PCT/US2008/058100, Apr. 14, 2009, 17 Pages.
Elbashir, S., et al., "Functional anatomy of siRNAs for mediating efficient RNAi in *Drosophila melanogaster* embryo lysate," The EMBO Journal, 2001, p. 6877-6888, vol. 20, No. 23.

(Continued)

*Primary Examiner*—Sean McGarry
*Assistant Examiner*—Terra Cotta Gibbs
(74) *Attorney, Agent, or Firm*—Fenwick & West LLP

(57) ABSTRACT

The invention relates to a double-stranded ribonucleic acid (dsRNA) for inhibiting the expression of a gene from the Ebola virus.

21 Claims, 8 Drawing Sheets

OTHER PUBLICATIONS

Soutschek, J., et al., Therapeutic silencing of an endogenous gene by systemic administration of modified siRNAs, Nov. 2004, Nature, vol. 432, pp. 173-178.

Vickers, T., et al., "Efficient Reduction of Target RNAs by Small Interfering RNA and RNase H-dependent Antisense Agents," The Journal of Biological Chemistry, Feb. 28, 2003, p. 7108-7118, vol. 278, No. 9.

Examiner's First Report on Australian Patent Application No. 2008232891, Apr. 19, 2010, 3 pages.

* cited by examiner

FIG. 8

COMPOSITIONS AND METHODS FOR INHIBITING EXPRESSION OF A GENE FROM THE EBOLA

CROSS-REFERENCE TO RELATED APPLICATIONS

This application claims priority to U.S. Provisional Application Ser. No. 60/908,793, filed Mar. 29, 2007. The entire contents of this provisional application are hereby incorporated by reference in the present application.

GOVERNMENT SUPPORT

This invention was made with government support under contract number HHSN266200600012C, ADB N01-AI-60012, awarded by the National Institute of Allergy and Infectious Diseases/National Institutes of Health/Department of Health and Human Services (NIAID/NIH/DHHS). The government has certain rights in the invention.

FIELD OF THE INVENTION

This invention relates to double-stranded ribonucleic acid (dsRNA), and its use in mediating RNA interference to inhibit the expression of one of the genes of the Ebola virus and the use of the dsRNA to treat pathological processes mediated by Ebola infection, such as systemic hemorrhage and multi-organ failure.

BACKGROUND OF THE INVENTION

Ebola Virus

Minus-strand (−) RNA viruses are major causes of human suffering that cause epidemics of serious human illness. In humans the diseases caused by these viruses include influenza (Orthomyxoviridae), mumps, measles, upper and lower respiratory tract disease (Paramyxoviridae), rabies (Rhabdoviridae), hemorrhagic fever (Filoviridae, Bunyaviridae and Arenaviridae), encephalitis (Bunyaviridae) and neurological illness (Bornaviridae). Virtually the entire human population is thought to be infected by many of these viruses.

The Ebola virus comes from the Filoviridae family, similar to the Marburg virus. It is named after the Ebola River in Zaire, Africa, near where the first outbreak was noted by Dr. Ngoy Mushola in 1976 after a significant outbreaks in both Yambuku, Zaire (now the Democratic Republic of the Congo), and Nzara, in western Sudan. Of 602 identified cases, there were 397 deaths.

The two strains identified in 1976 were named Ebola-Zaire (EBO-Z) and Ebola-Sudan (EBO-S). The outbreak in Sudan showed a lower fatality rate—50%—compared to the 90% mortality rate of the Zaire strain. In 1990, a second, similar virus was identified in Reston, Va. amongst monkeys imported from the Philippines, and was named Ebola-Reston.

Further outbreaks have occurred in Zaire/Congo (1995 and 2003), Gabon (1994, 1995 and 1996), and in Uganda (2000). A new subtype was identified from a single human case in the Côte d'Ivoire in 1994, EBO-CI.

Of around 1500 identified human Ebola infections, two-thirds of the patients have died. The animal (or other) reservoir which sustains the virus between outbreaks has not been identified.

Among humans, the Ebola virus is transmitted by direct contact with infected body fluids such as blood.

The incubation period of Ebola hemorrhagic fever varies from two days to four weeks. Symptoms are variable too, but the onset is usually sudden and characterised by high fever, prostration, myalgia, arthralgia, abdominal pains and headache. These symptoms progress to vomiting, diarrhea, oropharyngeal lesions, conjunctivitis, organ damage (notably the kidney and liver) by co-localized necrosis, proteinuria, and bleeding both internal and external, commonly through the gastrointestinal tract. Death or recovery to convalescence occurs within six to ten days of onset of symptomology.

The development of a successful therapeutic for Ebola virus is a long-sought and seemingly difficult endeavor. Although they cause only a few hundred deaths worldwide each year, filoviruses are considered a significant world health threat and have many of the characteristics commonly associated with biological weapons since they can be grown in large quantities, can be fairly stable, are highly infectious as an aerosol, and are exceptionally deadly. Filoviruses are relatively simple viruses of 19 Kb genomes and consist of seven genes which encode nucleoprotein (NP), glycoprotein (GP), four smaller viral proteins (VP24, VP30, VP35 and VP40), and the RNA-dependent RNA polymerase (L protein) all in a single strand of negative-sensed RNA. Administration of type I interferons, therapeutic vaccines, immune globulins, ribaverin, and other nucleoside analogues have been somewhat successful in rodent Ebola virus models, but not in nonhuman primate infection models.

In view of the severity of the diseases caused by (−) RNA viruses, in particular members of the Filoviridae family of viruses, and the lack of effective prevention or therapies, it is therefore an object of the present invention to provide therapeutic compounds and methods for treating a host infected with a (−) RNA virus.

siRNA

Double-stranded RNA molecules (dsRNA) have been shown to block gene expression in a highly conserved regulatory mechanism known as RNA interference (RNAi). WO 99/32619 (Fire et al.) discloses the use of a dsRNA of at least 25 nucleotides in length to inhibit the expression of genes in *C. elegans*. dsRNA has also been shown to degrade target RNA in other organisms, including plants (see, e.g., WO 99/53050, Waterhouse et al.; and WO 99/61631, Heifetz et al.), *Drosophila* (see, e.g., Yang, D., et al., Curr. Biol. (2000) 10:1191-1200), and mammals (see WO 00/44895, Limmer; and DE 101 00 586.5, Kreutzer et al.). This natural mechanism has now become the focus for the development of a new class of pharmaceutical agents for treating disorders that are caused by the aberrant or unwanted regulation of a gene.

Recent reports have indicated that in vitro, RNAi may show some promising in reducing Ebola replication and providing protection in guinea pigs (Geisbert, et al., The Journal of Infectious Diseases, 193 (2006), 1650-1657). However, the RNAi agents examined were not designed against all known Ebola strains and were not selected for stability and other properties needed for in vivo therapeutic RNAi agents. Accordingly, despite significant advances in the field of RNAi, there remains a need for an agent that can selectively and efficiently silence a gene in the Ebola virus using the cell's own RNAi machinery that has both high biological activity and in vivo stability, and that can effectively inhibit replication of the Ebola virus for use in treating pathological processes mediated by Ebola infection.

SUMMARY OF THE INVENTION

The invention provides double-stranded ribonucleic acid (dsRNA), as well as compositions and methods for inhibiting the expression of the Ebola virus in a cell or mammal using such dsRNA. The invention also provides compositions and methods for treating pathological conditions and diseases caused by Ebola viral infection, such as systemic hemorrhage and multi-organ failure. The dsRNA featured in the invention includes an RNA strand (the antisense strand) having a region which is less than 30 nucleotides in length, generally 19-24 nucleotides in length, and is substantially complementary to at least part of an mRNA transcript of a gene from the Ebola virus.

In one embodiment, the invention provides dsRNA molecules for inhibiting the expression of a gene of the Ebola virus and viral replication. The dsRNA comprises at least two sequences that are complementary to each other. The dsRNA comprises a sense strand comprising a first sequence and an antisense strand comprising a second sequence. The antisense strand comprises a nucleotide sequence which is substantially complementary to at least part of an mRNA encoded by a gene from the Ebola virus, and the region of complementarity is less than 30 nucleotides in length, generally 19-24 nucleotides in length. The dsRNA, upon contact with a cell infected with the Ebola virus, inhibits the expression of a gene from the Ebola virus by at least 40%.

For example, the dsRNA molecules of the invention can include a first sequence of the dsRNA that is selected from the group consisting of the sense sequences of Table 2 and the second sequence selected from the group consisting of the antisense sequences of Table 2. The dsRNA molecules featured in the invention can include naturally occurring nucleotides or can include at least one modified nucleotide, such as a 2'-O-methyl modified nucleotide, a nucleotide comprising a 5'-phosphorothioate group, and a terminal nucleotide linked to a cholesteryl derivative. Alternatively, the modified nucleotide may be chosen from the group of: a 2'-deoxy-2'-fluoro modified nucleotide, a 2'-deoxy-modified nucleotide, a locked nucleotide, an abasic nucleotide, 2'-amino-modified nucleotide, 2'-alkyl-modified nucleotide, morpholino nucleotide, a phosphoramidate, and a non-natural base comprising nucleotide. Generally, such modified sequence will be based on a first sequence of said dsRNA selected from the group consisting of the sense sequences of Table 2 and a second sequence selected from the group consisting of the antisense sequences of Table 2.

In another embodiment, the invention provides a cell having a dsRNA of the invention. The cell is generally a mammalian cell, such as a human cell.

In another embodiment, the invention provides a pharmaceutical composition for inhibiting the replication of the Ebola virus in an organism, generally a human subject. The composition includes one or more of the dsRNA of the invention and a pharmaceutically acceptable carrier or delivery vehicle.

In another embodiment, the invention provides a method for inhibiting the expression of a gene in the Ebola virus in a cell, including the following steps:

(a) introducing into the cell a double-stranded ribonucleic acid (dsRNA), wherein the dsRNA includes at least two sequences that are complementary to each other. The dsRNA includes a sense strand having a first sequence and an antisense strand having a second sequence. The antisense strand includes a region of complementarity which is substantially complementary to at least a part of an mRNA encoded by the Ebola virus, and wherein the region of complementarity is less than 30 nucleotides in length, generally 19-24 nucleotides in length, and optionally, wherein the dsRNA, upon contact with a cell infected with the Ebola virus, inhibits expression of a gene from the Ebola virus by at least 40%, such as in an assay described herein (e.g., a fluorscence-based assay); and (b) maintaining the cell produced in step (a) for a time sufficient to obtain degradation of the mRNA transcript of a Ebola gene, thereby inhibiting expression of a gene from the Ebola virus in the cell.

In another embodiment, the invention provides methods for treating, preventing or managing pathological processes mediated by Ebola infection, such as systemic hemorrhage and multi-organ failure, comprising administering to a patient in need of such treatment, prevention or management a therapeutically or prophylactically effective amount of one or more of the dsRNAs of the invention.

In another embodiment, the invention provides vectors for inhibiting the expression of a gene of the Ebola virus in a cell, comprising a regulatory sequence operably linked to a nucleotide sequence that encodes at least one strand of a dsRNA of the invention.

In another embodiment, the invention provides a cell comprising a vector for inhibiting the expression of a gene of the Ebola virus in a cell. The vector comprises a regulatory sequence operably linked to a nucleotide sequence that encodes at least one strand of a dsRNA of the invention.

In one aspect, the invention provides for a method of increasing the life-span of a subject (e.g., a mammal, such as a human or nonhuman primate) infected with an Ebola virus. The method includes administering a dsRNA to the subject, where the dsRNA includes an antisense RNA strand having a region which is less than 30 nucleotides in length, generally 19-24 nucleotides in length, and is substantially complementary to at least part of an mRNA transcript of a gene from the Ebola virus. The dsRNA is administered in an amount sufficient to increase the lifespan of the subject. In one embodiment, the dsRNA includes an antisense RNA strand having a region that is substantially complementary to at least part of an mRNA transcript of a gene selected from the VP30, VP35, NP, L, VP24, VP40 and GP genes. In a preferred embodiment, the dsRNA includes an antisense RNA strand having a region that is substantially complementary to at least part of an mRNA transcript of the VP35 gene. In some embodiments, the subject does not experience a decrease in one or both of lymphocyte or platelet count after administration of the dsRNA. In other embodiments, the subject does not experience an increase in cytokine levels (e.g., IFN-alpha or TNF-alpha levels).

In another aspect, the invention features a method of decreasing viral titre in a subject (e.g., a mammal, such as a human or nonhuman primate) infected with an Ebola virus. The method includes administering a dsRNA to the subject, where the dsRNA includes an antisense RNA strand having a region which is less than 30 nucleotides in length, generally 19-24 nucleotides in length, and is substantially complementary to at least part of an mRNA transcript of a gene from the Ebola virus. In one embodiment, the dsRNA includes an antisense RNA strand having a region that is substantially complementary to at least part of an mRNA transcript of the VP35 gene. In another embodiment, the subject does not experience a decrease in one or both of lymphocyte or platelet count after administration of the dsRNA. In other embodiments, the subject does not experience an increase in cytokine levels (e.g., IFN-alpha or TNF-alpha levels).

In another aspect, the invention features a method of sustaining lymphocyte or platelet count in a mammal (e.g., a human or nonhuman primate) infected with an Ebola virus. The method includes administering a dsRNA to the subject, where the dsRNA includes an antisense RNA strand having a region which is less than 30 nucleotides in length, generally 19-24 nucleotides in length, and is substantially complementary to at least part of an mRNA transcript of a gene from the Ebola virus. In one embodiment, the dsRNA includes an antisense RNA strand having a region that is substantially complementary to at least part of an mRNA transcript of the VP35 gene. In other embodiments, the subject does not experience an increase in cytokine levels (e.g., IFN-alpha or TNF-alpha levels).

BRIEF DESCRIPTION OF THE FIGURES

FIG. 8 is a graph presenting the observed decrease in viral titers in the serum of mice following administration of LNP01-formulated VP35 siRNA.

DETAILED DESCRIPTION OF THE INVENTION

Figure 1:
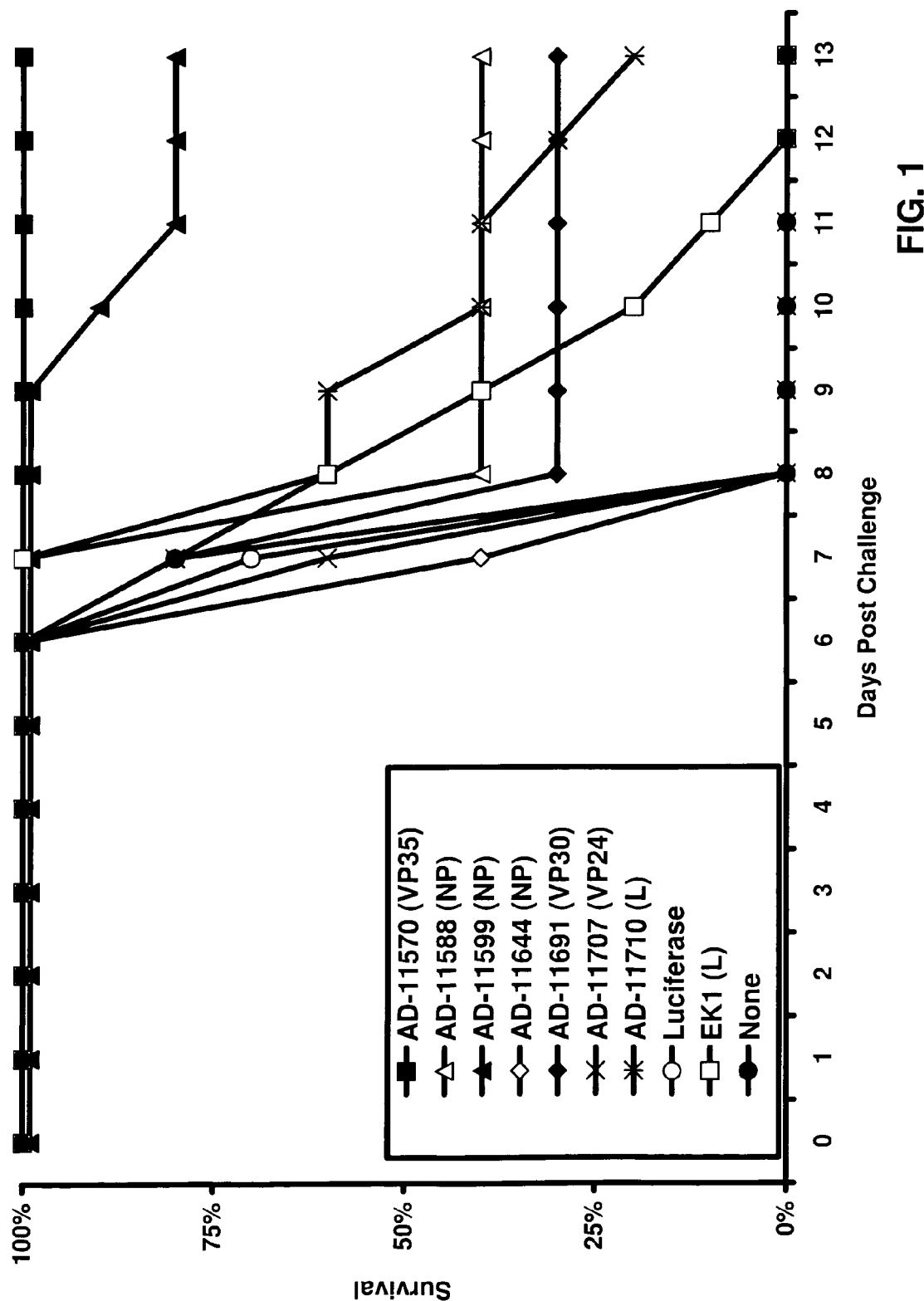
FIG. 1 is a graph showing that siRNAs formulated with lipidoid LNP01 protected mice from a lethal Ebola virus challenge.

The invention provides double-stranded ribonucleic acid (dsRNA), as well as compositions and methods for inhibiting the expression of a gene from the Ebola virus in a cell or mammal using the dsRNA. The invention also provides compositions and methods for treating pathological conditions and diseases in a mammal caused by Ebola infection using dsRNA. dsRNA directs the sequence-specific degradation of mRNA through a process known as RNA interference (RNAi).

The dsRNA of the invention comprises an RNA strand (the antisense strand) having a region which is less than 30 nucleotides in length, generally 19-24 nucleotides in length, and is substantially complementary to at least part of an mRNA transcript of a gene from the Ebola virus. The use of these dsRNAs enables the targeted degradation of mRNAs of genes that are implicated in replication and or maintenance of Ebola infection and the occurrence of systemic hemorrhage and multi-organ failure in a subject infected with the Ebola virus. Using cell-based and animal assays, the present inventors have demonstrated that very low dosages of these dsRNA can specifically and efficiently mediate RNAi, resulting in significant inhibition of expression of a gene from the Ebola virus. Thus, the methods and compositions of the invention comprising these dsRNAs are useful for treating pathological processes mediated by Ebolaviral infection by targeting a gene involved in Ebola relication and/or maintenance in a cell.

The following detailed description discloses how to make and use the dsRNA and compositions containing dsRNA to inhibit the expression of a gene from the Ebola virus, as well as compositions and methods for treating diseases and disorders caused by the infection with the Ebola virus, such as systemic hemorrhage and multi-organ failure. The pharmaceutical compositions of the invention comprise a dsRNA having an antisense strand comprising a region of complementarity which is less than 30 nucleotides in length, generally 19-24 nucleotides in length, and is substantially complementary to at least part of an RNA transcript of a gene from the Ebola virus, together with a pharmaceutically acceptable carrier.

Accordingly, certain aspects of the invention provide pharmaceutical compositions comprising the dsRNA of the invention together with a pharmaceutically acceptable carrier, methods of using the compositions to inhibit expression of a gene in a gene from the Ebola virus, and methods of using the pharmaceutical compositions to treat diseases caused by infection with the Ebola virus.

I. DEFINITIONS

For convenience, the meaning of certain terms and phrases used in the specification, examples, and appended claims, are provided below. If there is an apparent discrepancy between the usage of a term in other parts of this specification and its definition provided in this section, the definition in this section shall prevail.

"G," "C," "A" and "U" each generally stand for a nucleotide that contains guanine, cytosine, adenine, and uracil as a base, respectively. However, it will be understood that the term "ribonucleotide" or "nucleotide" can also refer to a modified nucleotide, as further detailed below, or a surrogate replacement moiety. The skilled person is well aware that guanine, cytosine, adenine, and uracil may be replaced by other moieties without substantially altering the base pairing properties of an oligonucleotide comprising a nucleotide bearing such replacement moiety. For example, without limitation, a nucleotide comprising inosine as its base may base pair with nucleotides containing adenine, cytosine, or uracil. Hence, nucleotides containing uracil, guanine, or adenine may be replaced in the nucleotide sequences of the invention by a nucleotide containing, for example, inosine. Sequences comprising such replacement moieties are embodiments of the invention.

As used herein, "Ebola viruses", are members of the family Filoviridae, are associated with outbreaks of highly lethal hemorrhagic fever in humans and nonhuman primates. Human pathogens include Ebola Zaire, Ebola Sudan, and Ebola Ivory Coast. Ebola Reston is a monkey pathogen and is not considered a significant human pathogen. The natural reservoir of the virus is unknown and there are currently no available vaccines or effective therapeutic treatments for filovirus infections. The genome of Ebola virus consists of a single strand of negative sense RNA that is approximately 19 kb in length. This RNA contains seven sequentially arranged genes that produce 8 mRNAs upon infection. Ebola virions, like virions of other filoviruses, contain seven proteins: a surface glycoprotein (GP), a nucleoprotein (NP), four virion structural proteins (VP40, VP35, VP30, and VP24), and an RNA-dependent RNA polymerase (L) (Feldmann et al. (1992) Virus Res. 24, 1-19; Sanchez et al., (1993) Virus Res. 29, 215-240; reviewed in Peters et al. (1996) In Fields Viroloqy, Third ed. pp. 1161-1176. Fields, B. N., Knipe, D. M., Howley, P. M., et al. eds. Lippincott-Raven Publishers, Philadelphia). The glycoprotein of Ebola virus is unusual in that it is encoded in two open reading frames. Transcriptional editing is needed to express the transmembrane form that is incorporated into the virion (Sanchez et al. (1996) Proc. Natl. Acad. Sci. USA 93, 3602-3607; Volchkov et al, (1995) Virology 214, 421-430).

As used herein, "target sequence" refers to a contiguous portion of the nucleotide sequence of an mRNA molecule formed during the transcription of a gene from the Ebola virus, including mRNA that is a product of RNA processing of a primary transcription product.

As used herein, the term "strand comprising a sequence" refers to an oligonucleotide comprising a chain of nucleotides that is described by the sequence referred to using the standard nucleotide nomenclature.

As used herein, and unless otherwise indicated, the term "complementary," when used to describe a first nucleotide sequence in relation to a second nucleotide sequence, refers to the ability of an oligonucleotide or polynucleotide comprising the first nucleotide sequence to hybridize and form a duplex structure under certain conditions with an oligonucleotide or polynucleotide comprising the second nucleotide sequence, as will be understood by the skilled person. Such conditions can, for example, be stringent conditions, where stringent conditions may include: 400 mM NaCl, 40 mM PIPES pH 6.4, 1 mM EDTA, 50° C. or 70° C. for 12-16 hours followed by washing. Other conditions, such as physiologically relevant conditions as may be encountered inside an organism, can apply. The skilled person will be able to determine the set of conditions most appropriate for a test of complementarity of two sequences in accordance with the ultimate application of the hybridized nucleotides.

This includes base-pairing of the oligonucleotide or polynucleotide comprising the first nucleotide sequence to the oligonucleotide or polynucleotide comprising the second nucleotide sequence over the entire length of the first and second nucleotide sequence. Such sequences can be referred to as "fully complementary" with respect to each other herein. However, where a first sequence is referred to as "substantially complementary" with respect to a second sequence herein, the two sequences can be fully complementary, or they may form one or more, but generally not more than 4, 3 or 2 mismatched base pairs upon hybridization, while retaining the ability to hybridize under the conditions most relevant to their ultimate application. However, where two oligonucleotides are designed to form, upon hybridization, one or more single stranded overhangs, such overhangs shall not be regarded as mismatches with regard to the determination of complementarity. For example, a dsRNA comprising one oligonucleotide 21 nucleotides in length and another oligonucleotide 23 nucleotides in length, wherein the longer oligonucleotide comprises a sequence of 21 nucleotides that is fully complementary to the shorter oligonucleotide, may yet be referred to as "fully complementary" for the purposes of the invention.

"Complementary" sequences, as used herein, may also include, or be formed entirely from, non-Watson-Crick base pairs and/or base pairs formed from non-natural and modified nucleotides, in as far as the above requirements with respect to their ability to hybridize are fulfilled.

The terms "complementary", "fully complementary" and "substantially complementary" herein may be used with respect to the base matching between the sense strand and the antisense strand of a dsRNA, or between the antisense strand of a dsRNA and a target sequence, as will be understood from the context of their use.

As used herein, a polynucleotide which is "substantially complementary to at least part of" a messenger RNA (mRNA) refers to a polynucleotide which is substantially complementary to a contiguous portion of the mRNA of interest (e.g., encoding Ebola). For example, a polynucleotide is complementary to at least a part of a Ebola mRNA if the sequence is substantially complementary to a non-interrupted portion of a mRNA encoding Ebola.

The term "double-stranded RNA" or "dsRNA," as used herein, refers to a complex of ribonucleic acid molecules, having a duplex structure comprising two anti-parallel and substantially complementary, as defined above, nucleic acid strands. The two strands forming the duplex structure may be different portions of one larger RNA molecule, or they may be separate RNA molecules. Where the two strands are part of one larger molecule, and therefore are connected by an uninterrupted chain of nucleotides between the 3'-end of one strand and the 5' end of the respective other strand forming the duplex structure, the connecting RNA chain is referred to as a "hairpin loop". Where the two strands are connected covalently by means other than an uninterrupted chain of nucleotides between the 3'-end of one strand and the 5' end of the respective other strand forming the duplex structure, the connecting structure is referred to as a "linker". The RNA strands may have the same or a different number of nucleotides. The maximum number of base pairs is the number of nucleotides in the shortest strand of the dsRNA minus any overhangs that are present in the duplex. In addition to the duplex structure, a dsRNA may comprise one or more nucleotide overhangs. dsRNAs as used herein are also referred to as "siRNAs" (short interfering RNAs).

As used herein, a "nucleotide overhang" refers to the unpaired nucleotide or nucleotides that protrude from the duplex structure of a dsRNA when a 3'-end of one strand of the dsRNA extends beyond the 5'-end of the other strand, or vice versa. "Blunt" or "blunt end" means that there are no unpaired nucleotides at that end of the dsRNA, i.e., no nucleotide overhang. A "blunt ended" dsRNA is a dsRNA that is double-stranded over its entire length, i.e., no nucleotide overhang at either end of the molecule.

The term "antisense strand" refers to the strand of a dsRNA which includes a region that is substantially complementary to a target sequence. As used herein, the term "region of complementarity" refers to the region on the antisense strand that is substantially complementary to a sequence, for example a target sequence, as defined herein. Where the region of complementarity is not fully complementary to the target sequence, the mismatches are most tolerated in the terminal regions and, if present, are generally in a terminal region or regions, e.g., within 6, 5, 4, 3, or 2 nucleotides of the 5' and/or 3' terminus.

The term "sense strand," as used herein, refers to the strand of a dsRNA that includes a region that is substantially complementary to a region of the antisense strand.

"Introducing into a cell", when referring to a dsRNA, means facilitating uptake or absorption into the cell, as is understood by those skilled in the art. Absorption or uptake of dsRNA can occur through unaided diffusive or active cellular processes, or by auxiliary agents or devices. The meaning of this term is not limited to cells in vitro; a dsRNA may also be "introduced into a cell", wherein the cell is part of a living organism. In such instance, introduction into the cell will include the delivery to the organism. For example, for in vivo delivery, dsRNA can be injected into a tissue site or administered systemically. In vitro introduction into a cell includes methods known in the art such as electroporation and lipofection.

The terms "silence" and "inhibit the expression of", in as far as they refer to a gene from the Ebola virus, herein refer to the at least partial suppression of the expression of a gene from the Ebola virus, as manifested by a reduction of the amount of mRNA transcribed from a gene from the Ebola virus which may be isolated from a first cell or group of cells in which a gene from the Ebola virus is transcribed and which has or have been treated such that the expression of a gene from the Ebola virus is inhibited, as compared to a second cell or group of cells substantially identical to the first cell or group of cells but which has or have not been so treated (control cells). The degree of inhibition is usually expressed in terms of $$\frac{(mRNA \text{ in control cells}) - (mRNA \text{ in treated cells})}{(mRNA \text{ in control cells})} \cdot 100\%$$

Alternatively, the degree of inhibition may be given in terms of a reduction of a parameter that is functionally linked to Ebola genome transcription, e.g. the amount of protein encoded by a gene from the Ebola virus, or the number of cells displaying a certain phenotype, e.g infection with the Ebola virus. In principle, Ebola genome silencing may be determined in any cell expressing the target, either constitutively or by genomic engineering, and by any appropriate assay. However, when a reference is needed in order to determine whether a given dsRNA inhibits the expression of a gene from the Ebola virus by a certain degree and therefore is encompassed by the instant invention, the assay provided in the Examples below shall serve as such reference.

For example, in certain instances, expression of a gene from the Ebola virus is suppressed by at least about 20%, 25%, 35%, or 50% by administration of the double-stranded oligonucleotide of the invention. In some embodiment, a gene from the Ebola virus is suppressed by at least about 60%, 70%, or 80% by administration of the double-stranded oligonucleotide of the invention. In some embodiments, a gene from the Ebola virus is suppressed by at least about 85%, 90%, or 95% by administration of the double-stranded oligonucleotide of the invention.

As used herein in the context of Ebola expression, the terms "treat", "treatment", and the like, refer to relief from or alleviation of pathological processes mediated by Ebola infection. In the context of the present invention insofar as it relates to any of the other conditions recited herein below (other than pathological processes mediated by Ebola expression), the terms "treat", "treatment", and the like mean to relieve or alleviate at least one symptom associated with such condition, or to slow or reverse the progression of such condition, or to reduce the amount of virus present in the infected subject.

As used herein, the phrases "therapeutically effective amount" and "prophylactically effective amount" refer to an amount that provides a therapeutic benefit in the treatment, prevention, or management of pathological processes mediated by Ebola infection or an overt symptom of pathological processes mediated by Ebola expression or the amount virus present in the patient. The specific amount that is therapeutically effective can be readily determined by ordinary medical practitioner, and may vary depending on factors known in the art, such as, e.g. the type of pathological processes mediated by Ebola infection, the patient's history and age, the stage of pathological processes mediated by Ebola infection, and the administration of other anti-pathological processes mediated by Ebola infection.

As used herein, a "pharmaceutical composition" comprises a pharmacologically effective amount of a dsRNA and a pharmaceutically acceptable carrier. As used herein, "pharmacologically effective amount," "therapeutically effective amount" or simply "effective amount" refers to that amount of an RNA effective to produce the intended pharmacological, therapeutic or preventive result. For example, if a given clinical treatment is considered effective when there is at least a 25% reduction in a measurable parameter associated with a disease or disorder, a therapeutically effective amount of a drug for the treatment of that disease or disorder is the amount necessary to effect at least a 25% reduction in that parameter. Further, the pharmaceutical composition can be designed to enhance targeting cells involved in Ebola infection such as dendritic cells, macrophages, hepatocytes, and other parenchymal cells.

The term "pharmaceutically acceptable carrier" refers to a carrier for administration of a therapeutic agent. Such carriers include, but are not limited to, saline, buffered saline, dextrose, water, glycerol, ethanol, and combinations thereof. The term specifically excludes cell culture medium. For drugs administered orally, pharmaceutically acceptable carriers include, but are not limited to pharmaceutically acceptable excipients such as inert diluents, disintegrating agents, binding agents, lubricating agents, sweetening agents, flavoring agents, coloring agents and preservatives. Suitable inert diluents include sodium and calcium carbonate, sodium and calcium phosphate, and lactose, while corn starch and alginic acid are suitable disintegrating agents. Binding agents may include starch and gelatin, while the lubricating agent, if present, will generally be magnesium stearate, stearic acid or talc. If desired, the tablets may be coated with a material such as glyceryl monostearate or glyceryl distearate, to delay absorption in the gastrointestinal tract.

As used herein, a "transformed cell" is a cell into which a vector has been introduced from which a dsRNA molecule may be expressed.

II. DOUBLE-STRANDED RIBONUCLEIC ACID (DSRNA)

In one embodiment, the invention provides double-stranded ribonucleic acid (dsRNA) molecules for inhibiting the expression of a gene from the Ebola virus in a cell or mammal, wherein the dsRNA comprises an antisense strand comprising a region of complementarity which is complementary to at least a part of an mRNA formed in the expression of a gene from the Ebola virus, and wherein the region of complementarity is less than 30 nucleotides in length, generally 19-24 nucleotides in length, and wherein said dsRNA, upon contact with a cell expressing the gene from the Ebola virus, inhibits the expression of the Ebola virus gene by at least 40%.

The dsRNA comprises two RNA strands that are sufficiently complementary to hybridize to form a duplex structure. One strand of the dsRNA (the antisense strand) comprises a region of complementarity that is substantially complementary, and generally fully complementary, to a target sequence, derived from the sequence of an mRNA formed during the expression of a gene from the Ebola virus, the other strand (the sense strand) comprises a region which is complementary to the antisense strand, such that the two strands hybridize and form a duplex structure when combined under suitable conditions. Generally, the duplex structure is between 15 and 30, more generally between 18 and 25, yet more generally between 19 and 24, and most generally between 19 and 21 base pairs in length. Similarly, the region of complementarity to the target sequence is between 15 and 30, more generally between 18 and 25, yet more generally between 19 and 24, and most generally between 19 and 21 nucleotides in length. The dsRNA of the invention may further comprise one or more single-stranded nucleotide overhang(s).

The dsRNA can be synthesized by standard methods known in the art as further discussed below, e.g., by use of an automated DNA synthesizer, such as are commercially available from, for example, Biosearch, Applied Biosystems, Inc. In one embodiment, a gene from the Ebola virus is the from human Ebola genome. In specific embodiments, the antisense strand of the dsRNA comprises the sense sequences of Table 2 and the second sequence is selected from the group consisting of the antisense sequences of Table 2. Alternative antisense agents that target elsewhere in the target sequence provided in Table 2 can readily be determined using the target sequence and the flanking Ebola sequence.

In further embodiments, the dsRNA comprises at least one nucleotide sequence selected from the groups of sequences provided in Table 2. In other embodiments, the dsRNA comprises at least two sequences selected from this group, wherein one of the at least two sequences is complementary to another of the at least two sequences, and one of the at least two sequences is substantially complementary to a sequence of an mRNA generated in the expression of a gene from the Ebola virus. Generally, the dsRNA comprises two oligonucleotides, wherein one oligonucleotide is described as the sense strand in Table 2 and the second oligonucleotide is described as the antisense strand in Table 2

The skilled person is well aware that dsRNAs comprising a duplex structure of between 20 and 23, but specifically 21, base pairs have been hailed as particularly effective in inducing RNA interference (Elbashir et al., EMBO 2001, 20:6877-6888). However, others have found that shorter or longer dsRNAs can be effective as well. In the embodiments described above, by virtue of the nature of the oligonucleotide sequences provided in Table 2, the dsRNAs of the invention can comprise at least one strand of a length of minimally 21 nucleotides. It can be reasonably expected that shorter dsRNAs comprising one of the sequences of Table 2 minus only a few nucleotides on one or both ends may be similarly effective as compared to the dsRNAs described above. Hence, dsRNAs comprising a partial sequence of at least 15, 16, 17, 18, 19, 20, or more contiguous nucleotides from one of the sequences of Table 2, and differing in their ability to inhibit the expression of a gene from the Ebola virus in a FACS assay as described herein below by not more than 5, 10, 15, 20, 25, or 30% inhibition from a dsRNA comprising the full sequence, are contemplated by the invention. Further dsRNAs that cleave within the target sequence provided in Table 2 can readily be made using the Ebola virus sequence and the target sequence provided.

In addition, the RNAi agents provided in Table 2 identify a site in the Ebola virus mRNA that is susceptible to RNAi based cleavage. As such the present invention further includes RNAi agents that target within the sequence targeted by one of the agents of the present invention. As used herein a second RNAi agent is said to target within the sequence of a first RNAi agent if the second RNAi agent cleaves the message anywhere within the mRNA that is complementary to the antisense strand of the first RNAi agent. Such a second agent will generally consist of at least 15 contiguous nucleotides from one of the sequences provided in Table 2 coupled to additional nucleotide sequences taken from the region contiguous to the selected sequence in a gene from the Ebola virus. For example, the last 15 nucleotides of SEQ ID NO:1 combined with the next 6 nucleotides from the target Ebola genome produces a single strand agent of 21 nucleotides that is based on one of the sequences provided in Table 2.

The dsRNA of the invention can contain one or more mismatches to the target sequence. In one embodiment, the dsRNA of the invention contains no more than 3 mismatches. If the antisense strand of the dsRNA contains mismatches to a target sequence, it is preferable that the area of mismatch not be located in the center of the region of complementarity. If the antisense strand of the dsRNA contains mismatches to the target sequence, it is preferable that the mismatch be restricted to 5 nucleotides from either end, for example 5, 4, 3, 2, or 1 nucleotide from either the 5' or 3' end of the region of complementarity. For example, for a 23 nucleotide dsRNA strand which is complementary to a region of a gene from the Ebola virus, the dsRNA generally does not contain any mismatch within the central 13 nucleotides. The methods described within the invention can be used to determine whether a dsRNA containing a mismatch to a target sequence is effective in inhibiting the expression of a gene from the Ebola virus. Consideration of the efficacy of dsRNAs with mismatches in inhibiting expression of a gene from the Ebola virus is important, especially if the particular region of complementarity in a gene from the Ebola virus is known to have polymorphic sequence variation within the population.

In one embodiment, at least one end of the dsRNA has a single-stranded nucleotide overhang of 1 to 4, generally 1 or 2 nucleotides. dsRNAs having at least one nucleotide overhang have unexpectedly superior inhibitory properties than their blunt-ended counterparts. Moreover, the present inventors have discovered that the presence of only one nucleotide overhang strengthens the interference activity of the dsRNA, without affecting its overall stability. dsRNA having only one overhang has proven particularly stable and effective in vivo, as well as in a variety of cells, cell culture mediums, blood, and serum. Generally, the single-stranded overhang is located at the 3'-terminal end of the antisense strand or, alternatively, at the 3'-terminal end of the sense strand. The dsRNA may also have a blunt end, generally located at the 5'-end of the antisense strand. Such dsRNAs have improved stability and inhibitory activity, thus allowing administration at low dosages, i.e., less than 5 mg/kg body weight of the recipient per day. Generally, the antisense strand of the dsRNA has a nucleotide overhang at the 3'-end, and the 5'-end is blunt. In another embodiment, one or more of the nucleotides in the overhang is replaced with a nucleoside thiophosphate.

In yet another embodiment, the dsRNA is chemically modified to enhance stability. The nucleic acids of the invention may be synthesized and/or modified by methods well established in the art, such as those described in "Current protocols in nucleic acid chemistry", Beaucage, S. L. et al. (Edrs.), John Wiley & Sons, Inc., New York, N.Y., USA, which is hereby incorporated herein by reference. Specific examples of dsRNA compounds useful in this invention include dsRNAs containing modified backbones or no natural internucleoside linkages. As defined in this specification, dsRNAs having modified backbones include those that retain a phosphorus atom in the backbone and those that do not have a phosphorus atom in the backbone. For the purposes of this specification, and as sometimes referenced in the art, modified dsRNAs that do not have a phosphorus atom in their internucleoside backbone can also be considered to be oligonucleosides.

Preferred modified dsRNA backbones include, for example, phosphorothioates, chiral phosphorothioates, phosphorodithioates, phosphotriesters, aminoalkylphosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5' linked analogs of these, and those) having inverted polarity wherein the adjacent pairs of nucleoside units are linked 3'-5' to 5'-3' or 2'-5' to 5'-2'. Various salts, mixed salts and free acid forms are also included.

Representative U.S. patents that teach the preparation of the above phosphorus-containing linkages include, but are not limited to, U.S. Pat. Nos. 3,687,808; 4,469,863; 4,476,301; 5,023,243; 5,177,195; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,316; 5,550,111; 5,563,253; 5,571,799; 5,587,361; and 5,625,050, each of which is herein incorporated by reference Preferred modified dsRNA backbones that do not include a phosphorus atom therein have backbones that are formed by short chain alkyl or cycloalkyl internucleoside linkages, mixed heteroatoms and alkyl or cycloalkyl internucleoside linkages, or ore or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and CH2 component parts.

Representative U.S. patents that teach the preparation of the above oligonucleosides include, but are not limited to, U.S. Pat. Nos. 5,034,506; 5,166,315; 5,185,444; 5,214,134; 5,216,141; 5,235,033; 5,64,562; 5,264,564; 5,405,938; 5,434,257; 5,466,677; 5,470,967; 5,489,677; 5,541,307; 5,561,225; 5,596,086; 5,602,240; 5,608,046; 5,610,289; 5,618,704; 5,623,070; 5,663,312; 5,633,360; 5,677,437; and, 5,677,439, each of which is herein incorporated by reference.

In other certain dsRNA mimetics, both the sugar and the internucleoside linkage, i.e., the backbone, of the nucleotide units are replaced with novel groups. The base units are maintained for hybridization with an appropriate nucleic acid target compound. One such oligomeric compound, an dsRNA mimetic that has been shown to have excellent hybridization properties, is referred to as a peptide nucleic acid (PNA). In PNA compounds, the sugar backbone of an dsRNA is replaced with an amide containing backbone, in particular an aminoethylglycine backbone. The nucleobases are retained and are bound directly or indirectly to aza nitrogen atoms of the amide portion of the backbone. Representative U.S. patents that teach the preparation of PNA compounds include, but are not limited to, U.S. Pat. Nos. 5,539,082; 5,714,331; and 5,719,262, each of which is herein incorporated by reference. Further teaching of PNA compounds can be found in Nielsen et al., Science, 1991, 254, 1497-1500.

Other embodiments featured in the invention include dsRNAs with phosphorothioate backbones and oligonucleosides with heteroatom backbones, and in particular —CH.sub.2-NH—CH.sub.2-, —CH.sub.2-N(CH.sub.3)-O—CH.sub.2-[known as a methylene (methylimino) or MMI backbone], —CH.sub.2-O—N(CH.sub.3)-CH.sub.2-, —CH.sub.2-N(CH.sub.3)-N(CH.sub.3)-CH.sub.2- and —N(CH.sub.3)-CH.sub.2-CH.sub.2-[wherein the native phosphodiester backbone is represented as —O—P—O—CH.sub.2-] of the above-referenced U.S. Pat. No. 5,489,677, and the amide backbones of the above-referenced U.S. Pat. No. 5,602,240. Also preferred are dsRNAs having morpholino backbone structures of the above-referenced U.S. Pat. No. 5,034,506.

Modified dsRNAs may also contain one or more substituted sugar moieties. In some embodiment, the dsRNAs include one of the following at the 2' position: OH; F; O—, S—, or N-alkyl; O-, S-, or N-alkenyl; O—, S- or N-alkynyl; or O-alkyl-O-alkyl, wherein the alkyl, alkenyl and alkynyl may be substituted or unsubstituted C.sub.1 to C.sub.10 alkyl or C.sub.2 to C.sub.10 alkenyl and alkynyl. Particularly preferred are O[(CH.sub.2).sub.nO].sub.mCH.sub.3, O(CH.sub.2).sub.nOCH.sub.3, O(CH.sub.2).sub.nNH.sub.2, O(CH.sub.2).sub.nCH.sub.3, O(CH.sub.2).sub.nONH.sub.2, and O(CH.sub.2).sub.nON[(CH.sub.2).sub.nCH.sub.3)].sub.2, where n and m are from 1 to about 10. Other preferred dsRNAs comprise one of the following at the 2' position: C.sub.1 to C.sub.10 lower alkyl, substituted lower alkyl, alkaryl, aralkyl, O-alkaryl or O-aralkyl, SH, SCH.sub.3, OCN, Cl, Br, CN, CF.sub.3, OCF.sub.3, SOCH.sub.3, SO.sub.2CH.sub.3, ONO.sub.2, NO.sub.2, N.sub.3, NH.sub.2, heterocycloalkyl, heterocycloalkaryl, aminoalkylamino, polyalkylamino, substituted silyl, an RNA cleaving group, a reporter group, an intercalator, a group for improving the pharmacokinetic properties of an dsRNA, or a group for improving the pharmacodynamic properties of an dsRNA, and other substituents having similar properties. A preferred modification includes 2'-methoxyethoxy (2'-O—CH.sub.2CH.sub.2OCH.sub.3, also known as 2'-O-(2-methoxyethyl) or 2'-MOE) (Martin et al., Helv. Chim. Acta, 1995, 78, 486-504) i.e., an alkoxy-alkoxy group. A further preferred modification includes 2'-dimethylaminooxyethoxy, i.e., a O(CH.sub.2).sub.2ON(CH.sub.3).sub.2 group, also known as 2'-DMAOE, as described in examples hereinbelow, and 2'-dimethylaminoethoxyethoxy (also known in the art as 2'-O-dimethylaminoethoxyethyl or 2'-DMAEOE), i.e., 2'-O—CH.sub.2-O—CH.sub.2-N(CH.sub.2).sub.2, also described in examples hereinbelow.

Other preferred modifications include 2'-methoxy (2'-OCH.sub.3), 2'-aminopropoxy (2'-OCH.sub.2CH.sub.2CH.sub.2NH.sub.2) and 2'-fluoro (2'-F). Similar modifications may also be made at other positions on the dsRNA, particularly the 3' position of the sugar on the 3' terminal nucleotide or in 2'-5' linked dsRNAs and the 5' position of 5' terminal nucleotide. DsRNAs may also have sugar mimetics such as cyclobutyl moieties in place of the pentofuranosyl sugar. Representative U.S. patents that teach the preparation of such modified sugar structures include, but are not limited to, U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; and 5,700,920, certain of which are commonly owned with the instant application, and each of which is herein incorporated by reference in its entirety.

dsRNAs may also include nucleobase (often referred to in the art simply as "base") modifications or substitutions. As used herein, "unmodified" or "natural" nucleobases include the purine bases adenine (A) and guanine (G), and the pyrimidine bases thymine (T), cytosine (C) and uracil (U). Modified nucleobases include other synthetic and natural nucleobases such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl anal other 8-substituted adenines and guanines, 5-halo, particularly 5-bromo, 5-trifluoromethyl and other 5-substituted uracils and cytosines, 7-methylguanine and 7-methyladenine, 8-azaguanine and 8-azaadenine, 7-deazaguanine and 7-daazaadenine and 3-deazaguanine and 3-deazaadenine. Further nucleobases include those disclosed in U.S. Pat. No. 3,687,808, those disclosed in The Concise Encyclopedia Of Polymer Science And Engineering, pages 858-859, Kroschwitz, J. L, ed. John Wiley & Sons, 1990, these disclosed by Englisch et al., Angewandte Chemie, International Edition, 1991, 30, 613, and those disclosed by Sanghvi, Y S., Chapter 15, DsRNA Research and Applications, pages 289-302, Crooke, S. T. and Lebleu, B., Ed., CRC Press, 1993. Certain of these nucleobases are particularly useful for increasing the binding affinity of the oligomeric compounds of the invention. These include 5-substituted pyrimidines, 6-azapyrimidines and N-2, N-6 and 0-6 substituted purines, including 2-aminopropyladenine, 5-propynyluracil and 5-propynylcytosine. 5-methylcytosine substitutions have been shown to increase nucleic acid duplex stability by 0.6-1.2.degree. C. (Sanghvi, Y. S., Crooke, S. T. and Lebleu, B., Eds., DsRNA Research and Applications, CRC Press, Boca Raton, 1993, pp. 276-278) and are presently preferred base substitutions, even more particularly when combined with 2'-O-methoxyethyl sugar modifications.

Other nucleotide substitutions, such as "Universal" bases can be incorporated into siRNA duplexes to increase the number of target sequences (or in this case, number of different Ebola strains) any particular siRNA might have complementarity to and activity against. Universal bases are non-canonical synthetic molecules that mimic structures of traditional nucleotides (the genetic building blocks of DNA and RNA). However, instead of selectively pairing according to Watson/Crick rules (A with T or U, C with G), universal bases 'stack' equally well with all natural bases. Incorporating universal bases into siRNAs may enable the siRNA to tolerate a mutation at that specific site in its target mRNA. Thus, by decreasing the need for absolute complementarity between siRNA and its mRNA target, universal-base containing siRNAs may be an approach to (1) prevent drug resistance caused by site-specific viral mutations and (2) create siRNAs able to be broadly reactive across viral species with similar, but not absolutely conserved, targets. Among the modifications that can be used as universal basaes are: 3-Nitropyrrole, 5-Nitroindole, Imidazole-4-Carboxamide, 2,4-difluorotoluoyl, and Inosine.

Representative U.S. patents that teach the preparation of certain of the above noted modified nucleobases as well as other modified nucleobases include, but are not limited to, the above noted U.S. Pat. No. 3,687,808, as well as U.S. Pat. Nos. 4,845,205; 5,130,30; 5,134,066; 5,175,273; 5,367,066; 5,432,272; 5,457,187; 5,459,255; 5,484,908; 5,502,177; 5,525,711; 5,552,540; 5,587,469; 5,594,121, 5,596,091; 5,614,617; and 5,681,941, each of which is herein incorporated by reference, and U.S. Pat. No. 5,750,692, also herein incorporated by reference.

Another modification of the dsRNAs of the invention involves chemically linking to the dsRNA one or more moieties or conjugates which enhance the activity, cellular distribution or cellular uptake of the dsRNA. Such moieties include but are not limited to lipid moieties such as a cholesterol moiety (Letsinger et al., Proc. Natl. Acid. Sci. USA, 199, 86, 6553-6556), cholic acid (Manoharan et al., Biorg. Med. Chem. Let., 1994 4 1053-1060), a thioether, e.g., beryl-S-tritylthiol (Manoharan et al., Ann. N.Y. Acad. Sci., 1992, 660, 306-309; Manoharan et al., Biorg. Med. Chem. Let., 1993, 3, 2765-2770), a thiocholesterol (Oberhauser et al., Nucl. Acids Res., 1992, 20, 533-538), an aliphatic chain, e.g., dodecandiol or undecyl residues (Saison-Behmoaras et al., EMBO J, 1991, 10, 1111-1118; Kabanov et al., FEBS Lett., 1990, 259, 327-330; Svinarchuk et al., Biochimie, 1993, 75, 49-54), a phospholipid, e.g., di-hexadecyl-rac-glycerol or triethyl-ammonium 1,2-di-O-hexadecyl-rac-glycero-3-Hphosphonate (Manoharan et al., Tetrahedron Lett., 1995, 36, 3651-3654; Shea et al., Nucl. Acids Res., 1990, 18, 3777-3783), a polyamine or a polyethylene glycol chain (Manoharan et al., Nucleosides & Nucleotides, 1995, 14, 969-973), or adamantane acetic acid (Manoharan et al., Tetrahedron Lett., 1995, 36, 3651-3654), a palmityl moiety (Mishra et al., Biochim. Biophys. Acta, 1995, 1264, 229-237), or an octadecylamine or hexylamino-carbonyloxycholesterol moiety (Crooke et al., J. Pharmacol. Exp. Ther., 1996, 277, 923-937). Preferred conjugates will assist in targeting cells infected by Ebola virus such as dendritic cells and macrophages which are involved in early stages of infection and epatocytes and other parenchymal cells which are involved in later phases of the infection. Such conjugates include, but are not limited to, mannose and folate conjugates.

Representative U.S. patents that teach the preparation of such dsRNA conjugates include, but are not limited to, U.S. Pat. Nos. 4,828,979; 4,948,882; 5,218,105; 5,525,465; 5,541,313; 5,545,730; 5,552,538; 5,578,717, 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241, 5,391,723; 5,416,203, 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928 and 5,688,941, each of which is herein incorporated by reference.

It is not necessary for all positions in a given compound to be uniformly modified, and in fact more than one of the aforementioned modifications may be incorporated in a single compound or even at a single nucleoside within an dsRNA. The present invention also includes dsRNA compounds which are chimeric compounds. "Chimeric" dsRNA compounds or "chimeras," in the context of this invention, are dsRNA compounds, particularly dsRNAs, which contain two or more chemically distinct regions, each made up of at least one monomer unit, i.e., a nucleotide in the case of an dsRNA compound. These dsRNAs typically contain at least one region wherein the dsRNA is modified so as to confer upon the dsRNA increased resistance to nuclease degradation, increased cellular uptake, and/or increased binding affinity for the target nucleic acid. An additional region of the dsRNA may serve as a substrate for enzymes capable of cleaving RNA:DNA or RNA:RNA hybrids. By way of example, RNase H is a cellular endonuclease which cleaves the RNA strand of an RNA:DNA duplex. Activation of RNase H, therefore, results in cleavage of the RNA target, thereby greatly enhancing the efficiency of dsRNA inhibition of gene expression. Consequently, comparable results can often be obtained with shorter dsRNAs when chimeric dsRNAs are used, compared to phosphorothioate deoxydsRNAs hybridizing to the same target region. Cleavage of the RNA target can be routinely detected by gel electrophoresis and, if necessary, associated nucleic acid hybridization techniques known in the art.

In certain instances, the dsRNA may be modified by a non-ligand group. A number of non-ligand molecules have been conjugated to dsRNAs in order to enhance the activity, cellular distribution or cellular uptake of the dsRNA, and procedures for performing such conjugations are available in the scientific literature. Such non-ligand moieties have included lipid moieties, such as cholesterol (Letsinger et al., Proc. Natl. Acad. Sci. USA, 1989, 86:6553), cholic acid (Manoharan et al., Bioorg. Med. Chem. Lett., 1994, 4:1053), a thioether, e.g., hexyl-5-tritylthiol (Manoharan et al., Ann. N.Y. Acad. Sci., 1992, 660:306; Manoharan et al., Bioorg. Med. Chem. Let., 1993, 3:2765), a thiocholesterol (Oberhauser et al., Nucl. Acids Res., 1992, 20:533), an aliphatic chain, e.g., dodecandiol or undecyl residues (Saison-Behmoaras et al., EMBO J., 1991, 10:111; Kabanov et al., FEBS Lett., 1990, 259:327; Svinarchuk et al., Biochimie, 1993, 75:49), a phospholipid, e.g., di-hexadecyl-rac-glycerol or tri-ethylammonium 1,2-di-O-hexadecyl-rac-glycero-3-H-phosphonate (Manoharan et al., Tetrahedron Lett., 1995, 36:3651; Shea et al., Nucl. Acids Res., 1990, 18:3777), a polyamine or a polyethylene glycol chain (Manoharan et al., Nucleosides & Nucleotides, 1995, 14:969), or adamantane acetic acid (Manoharan et al., Tetrahedron Lett., 1995, 36:3651), a palmityl moiety (Mishra et al., Biochim. Biophys. Acta, 1995, 1264:229), or an octadecylamine or hexylamino-carbonyl-oxycholesterol moiety (Crooke et al., J. Pharmacol. Exp. Ther., 1996, 277:923). Representative United States patents that teach the preparation of such dsRNA conjugates have been listed above. Typical conjugation protocols involve the synthesis of dsRNAs bearing an aminolinker at one or more positions of the sequence. The amino group is then reacted with the molecule being conjugated using appropriate coupling or activating reagents. The conjugation reaction may be performed either with the dsRNA still bound to the solid support or following cleavage of the dsRNA in solution phase. Purification of the dsRNA conjugate by HPLC typically affords the pure conjugate.

Vector Encoded RNAi Agents

The dsRNA of the invention can also be expressed from recombinant viral vectors intracellularly in vivo. The recombinant viral vectors of the invention comprise sequences encoding the dsRNA of the invention and any suitable promoter for expressing the dsRNA sequences. Suitable promoters include, for example, the U6 or H1 RNA pol III promoter sequences and the cytomegalovirus promoter. Selection of other suitable promoters is within the skill in the art. The recombinant viral vectors of the invention can also comprise inducible or regulatable promoters for expression of the dsRNA in a particular tissue or in a particular intracellular environment. The use of recombinant viral vectors to deliver dsRNA of the invention to cells in vivo is discussed in more detail below.

dsRNA of the invention can be expressed from a recombinant viral vector either as two separate, complementary RNA molecules, or as a single RNA molecule with two complementary regions.

Any viral vector capable of accepting the coding sequences for the dsRNA molecule(s) to be expressed can be used, for example vectors derived from adenovirus (AV); adeno-associated virus (AAV); retroviruses (e.g, lentiviruses (LV), Rhabdoviruses, murine leukemia virus); herpes virus, and the like. The tropism of viral vectors can be modified by pseudotyping the vectors with envelope proteins or other surface antigens from other viruses, or by substituting different viral capsid proteins, as appropriate.

For example, lentiviral vectors of the invention can be pseudotyped with surface proteins from vesicular stomatitis virus (VSV), rabies, Ebola, Mokola, and the like. AAV vectors of the invention can be made to target different cells by engineering the vectors to express different capsid protein serotypes. For example, an AAV vector expressing a serotype 2 capsid on a serotype 2 genome is called AAV 2/2. This serotype 2 capsid gene in the AAV 2/2 vector can be replaced by a serotype 5 capsid gene to produce an AAV 2/5 vector. Techniques for constructing AAV vectors which express different capsid protein serotypes are within the skill in the art; see, e.g., Rabinowitz J E et al. (2002), J Virol 76:791-801, the entire disclosure of which is herein incorporated by reference.

Selection of recombinant viral vectors suitable for use in the invention, methods for inserting nucleic acid sequences for expressing the dsRNA into the vector, and methods of delivering the viral vector to the cells of interest are within the skill in the art. See, for example, Dornburg R (1995), Gene Therap. 2: 301-310; Eglitis M A (1988), Biotechniques 6: 608-614; Miller A D (1990), Hum Gene Therap. 1: 5-14; Anderson W F (1998), Nature 392: 25-30; and Rubinson D A et al., Nat. Genet. 33: 401-406, the entire disclosures of which are herein incorporated by reference.

Preferred viral vectors are those derived from AV and AAV. In a particularly preferred embodiment, the dsRNA of the invention is expressed as two separate, complementary single-stranded RNA molecules from a recombinant AAV vector comprising, for example, either the U6 or H1 RNA promoters, or the cytomegalovirus (CMV) promoter.

A suitable AV vector for expressing the dsRNA of the invention, a method for constructing the recombinant AV vector, and a method for delivering the vector into target cells, are described in Xia H et al. (2002), Nat. Biotech. 20: 1006-1010.

Suitable AAV vectors for expressing the dsRNA of the invention, methods for constructing the recombinant AV vector, and methods for delivering the vectors into target cells are described in Samulski R et al. (1987), J. Virol. 61: 3096-3101; Fisher K J et al. (1996), J. Virol, 70: 520-532; Samulski R et al. (1989), J. Virol. 63: 3822-3826; U.S. Pat. No. 5,252,479; U.S. Pat. No. 5,139,941; International Patent Application No. WO 94/13788; and International Patent Application No. WO 93/24641, the entire disclosures of which are herein incorporated by reference.

III. PHARMACEUTICAL COMPOSITIONS COMPRISING DSRNA

In one embodiment, the invention provides pharmaceutical compositions comprising a dsRNA, as described herein, and a pharmaceutically acceptable carrier. The pharmaceutical composition comprising the dsRNA is useful for treating a disease or disorder associated with the expression or activity of a gene from the Ebola virus and/or viral infection, such as systemic hemorrhage and multi-organ failure. Such pharmaceutical compositions are formulated based on the mode of delivery. One example is compositions that are formulated for systemic administration via parenteral delivery.

The pharmaceutical compositions of the invention are administered in dosages sufficient to inhibit expression of a gene from the Ebola virus. A maximum dosage of 5 mg dsRNA per kilogram body weight of recipient per day is sufficient to inhibit or completely suppress expression of a gene from the Ebola virus.

In general, a suitable dose of dsRNA will be in the range of 0.01 to 20.0 milligrams per kilogram body weight of the recipient per day, and optimally in the range of 0.01 to 3 mg per kilogram body weight per day. The pharmaceutical composition may be administered once daily, or the dsRNA may be administered as two, three, or more sub-doses at appropriate intervals throughout the day or even using continuous infusion or delivery through a controlled release formulation. In that case, the dsRNA contained in each sub-dose must be correspondingly smaller in order to achieve the total daily dosage. The dosage unit can also be compounded for delivery over several days, e.g., using a conventional sustained release formulation which provides sustained release of the dsRNA over a several day period. In this embodiment, the dosage unit contains a corresponding multiple of the daily dose.

The skilled artisan will appreciate that certain factors may influence the dosage and timing required to effectively treat a subject, including but not limited to the severity of the disease or disorder, previous treatments, the general health and/or age of the subject, and other diseases present. Moreover, treatment of a subject with a therapeutically effective amount of a composition can include a single treatment or a series of treatments. Estimates of effective dosages and in vivo half-lives for the individual dsRNAs encompassed by the invention can be made using conventional methodologies or on the basis of in vivo testing using an appropriate animal model, as described elsewhere herein.

Advances in animal modeling has generated a number of Ebola infection models (mouse, guinea pig, and non-human primate) that reproduce all the major pathologies associated with human Ebola infection (reviewed in Warfield, K. L. et al. (2006) "Chapter 13: Viral Hemorrhagic Fevers" in *Biodefense: Research Methodology and Animal Models*, pages 227-258, J. R. Swearengen, Ed., Taylor & Francis, Boca Raton). Such models are used for in vivo testing of dsRNA, as well as for determining a therapeutically effective dose.

The present invention also includes pharmaceutical compositions and formulations which include the dsRNA compounds of the invention. The pharmaceutical compositions of the present invention may be administered in a number of ways depending upon whether local or systemic treatment is desired and upon the area to be treated. Administration may be topical, pulmonary, e.g., by inhalation or insufflation of powders or aerosols, including by nebulizer; intratracheal, intranasal, epidermal and transdermal), oral or parenteral. Parenteral administration includes intravenous, intraarterial, subcutaneous, intraperitoneal or intramuscular injection or infusion.

Compositions and formulations for oral administration include powders or granules, microparticulates, nanoparticulates, suspensions or solutions in water or non-aqueous media, capsules, gel capsules, sachets, tablets or minitablets. Thickeners, flavoring agents, diluents, emulsifiers, dispersing aids or binders may be desirable.

Compositions and formulations for parenteral, intrathecal or intraventricular administration may include sterile aqueous solutions which may also contain buffers, diluents and other suitable additives such as, but not limited to, penetration enhancers, carrier compounds and other pharmaceutically acceptable carriers or excipients.

Pharmaceutical compositions of the present invention include, but are not limited to, solutions, emulsions, and liposome-containing formulations. These compositions may be generated from a variety of components that include, but are not limited to, preformed liquids, self-emulsifying solids and self-emulsifying semisolids.

The pharmaceutical formulations of the present invention, which may conveniently be presented in unit dosage form, may be prepared according to conventional techniques well known in the pharmaceutical industry. Such techniques include the step of bringing into association the active ingredients with the pharmaceutical carrier(s) or excipient(s). In general, the formulations are prepared by uniformly and intimately bringing into association the active ingredients with liquid carriers or finely divided solid carriers or both, and then, if necessary, shaping the product.

Liposomes

There are many organized surfactant structures besides microemulsions that have been studied and used for the formulation of drugs. These include monolayers, micelles, bilayers and vesicles. Vesicles, such as liposomes, have attracted great interest because of their specificity and the duration of action they offer from the standpoint of drug delivery. Liposomal delivery systems have been used to effectively deliver siRNA in vivo and silence genes in hepatocytes [Zimmermann et al. (2006) *Nature,* 441:111-114]. Such siRNA-liposomal formulations have also been used for therapeutic benefit in animal models of dyslipidemias [Zimmermann et al. (2006) *Nature,* 441:111-114], HBV infection [Morrissey et al. (2005) *Nature Biotech* 23:1002-1007], Ebola infection [Geisbert, et al. (2006) *The Journal of Infectious Diseases,* 193:1650-1657], and rheumatoid arthritis [Khoury et al. (2006) *Arthritis & Rheumatism,* 54:1867-1877]. As used in the present invention, the term "liposome" means a vesicle composed of amphiphilic lipids arranged in a spherical bilayer or bilayers.

Liposomes are unilamellar or multilamellar vesicles which have a membrane formed from a lipophilic material and an aqueous interior. The aqueous portion contains the composition to be delivered. Cationic liposomes possess the advantage of being able to fuse to the cell wall. Non-cationic liposomes, although not able to fuse as efficiently with the cell wall, are phagocytosed by macrophages and other cells in vivo.

Further advantages of liposomes include; liposomes obtained from natural phospholipids are biocompatible and biodegradable; liposomes can incorporate a wide range of water and lipid soluble drugs; liposomes can protect encapsulated drugs in their internal compartments from metabolism and degradation (Rosoff, in Pharmaceutical Dosage Forms, Lieberman, Rieger and Banker (Eds.), 1988, Marcel Dekker, Inc., New York, N.Y., volume 1, p. 245). Important considerations in the preparation of liposome formulations are the lipid surface charge, vesicle size and the aqueous volume of the liposomes.

Liposomes are useful for the transfer and delivery of active ingredients to the site of action. Because the liposomal membrane is structurally similar to biological membranes, when liposomes are applied to a tissue, the liposomes start to merge with the cellular membranes and as the merging of the liposome and cell progresses, the liposomal contents are emptied into the cell where the active agent may act.

Liposomal formulations have been the focus of extensive investigation as the mode of delivery for many drugs. There is growing evidence that for topical administration, liposomes present several advantages over other formulations. Such advantages include reduced side-effects related to high systemic absorption of the administered drug, increased accumulation of the administered drug at the desired target, and the ability to administer a wide variety of drugs, both hydrophilic and hydrophobic, into the skin.

Several reports have detailed the ability of liposomes to deliver agents including high-molecular weight DNA into the skin. Compounds including analgesics, antibodies, hormones and high-molecular weight DNAs have been administered to the skin. The majority of applications resulted in the targeting of the upper epidermis Liposomes fall into two broad classes. Cationic liposomes are positively charged liposomes which interact with the negatively charged DNA molecules to form a stable complex. The positively charged DNA/liposome complex binds to the negatively charged cell surface and is internalized in an endosome. Due to the acidic pH within the endosome, the liposomes are ruptured, releasing their contents into the cell cytoplasm (Wang et al., Biochem. Biophys. Res. Commun., 1987, 147, 980-985).

Liposomes which are pH-sensitive or negatively-charged, entrap DNA rather than complex with it. Since both the DNA and the lipid are similarly charged, repulsion rather than complex formation occurs. Nevertheless, some DNA is entrapped within the aqueous interior of these liposomes. pH-sensitive liposomes have been used to deliver DNA encoding the thymidine kinase gene to cell monolayers in culture. Expression of the exogenous gene was detected in the target cells (Zhou et al., Journal of Controlled Release, 1992, 19, 269-274).

One major type of liposomal composition includes phospholipids other than naturally-derived phosphatidylcholine. Neutral liposome compositions, for example, can be formed from dimyristoyl phosphatidylcholine (DMPC) or dipalmitoyl phosphatidylcholine (DPPC). Anionic liposome compositions generally are formed from dimyristoyl phosphatidylglycerol, while anionic fusogenic liposomes are formed primarily from dioleoyl phosphatidylethanolamine (DOPE). Another type of liposomal composition is formed from phosphatidylcholine (PC) such as, for example, soybean PC, and egg PC. Another type is formed from mixtures of phospholipid and/or phosphatidylcholine and/or cholesterol.

Liposomes also include "sterically stabilized" liposomes, a term which, as used herein, refers to liposomes comprising one or more specialized lipids that, when incorporated into liposomes, result in enhanced circulation lifetimes relative to liposomes lacking such specialized lipids. Examples of sterically stabilized liposomes are those in which part of the vesicle-forming lipid portion of the liposome (A) comprises one or more glycolipids, such as monosialoganglioside $G_{M1}$, or (B) is derivatized with one or more hydrophilic polymers, such as a polyethylene glycol (PEG) moiety. While not wishing to be bound by any particular theory, it is thought in the art that, at least for sterically stabilized liposomes containing gangliosides, sphingomyelin, or PEG-derivatized lipids, the enhanced circulation half-life of these sterically stabilized liposomes derives from a reduced uptake into cells of the reticuloendothelial system (RES) (Allen et al., FEBS Letters, 1987, 223, 42; Wu et al., Cancer Research, 1993, 53, 3765). Various liposomes comprising one or more glycolipids are known in the art. Papahadjopoulos et al. (Ann. N.Y. Acad. Sci., 1987, 507, 64) reported the ability of monosialoganglioside $G_{M1}$, galactocerebroside sulfate and phosphatidylinositol to improve blood half-lives of liposomes. These findings were expounded upon by Gabizon et al. (Proc. Natl. Acad. Sci. U.S.A., 1988, 85, 6949). U.S. Pat. No. 4,837,028 and WO 88/04924, both to Allen et al., disclose liposomes comprising (1) sphingomyelin and (2) the ganglioside $G_{M1}$ or a galactocerebroside sulfate ester. U.S. Pat. No. 5,543,152 (Webb et al.) discloses liposomes comprising sphingomyelin. Liposomes comprising 1,2-sn-dimyristoylphosphat-idylcholine are disclosed in WO 97/13499 (Lim et al).

Many liposomes comprising lipids derivatized with one or more hydrophilic polymers, and methods of preparation thereof, are known in the art. Sunamoto et al. (Bull. Chem. Soc. Jpn., 1980, 53, 2778) described liposomes comprising a nonionic detergent, $2C_{1215G}$, that contains a PEG moiety. Illum et al. (FEBS Lett., 1984, 167, 79) noted that hydrophilic coating of polystyrene particles with polymeric glycols results in significantly enhanced blood half-lives. Synthetic phospholipids modified by the attachment of carboxylic groups of polyalkylene glycols (e.g., PEG) are described by Sears (U.S. Pat. Nos. 4,426,330 and 4,534,899). Klibanov et al. (FEBS Lett., 1990, 268, 235) described experiments demonstrating that liposomes comprising phosphatidylethanolamine (PE) derivatized with PEG or PEG stearate have significant increases in blood circulation half-lives. Blume et al. (Biochimica et Biophysica Acta, 1990, 1029, 91) extended such observations to other PEG-derivatized phospholipids, e.g., DSPE-PEG, formed from the combination of distearoylphosphatidylethanolamine (DSPE) and PEG. Liposomes having covalently bound PEG moieties on their external surface are described in European Patent No. EP 0 445 131 B1 and WO 90/04384 to Fisher. Liposome compositions containing 1-20 mole percent of PE derivatized with PEG, and methods of use thereof, are described by Woodle et al. (U.S. Pat. Nos. 5,013,556 and 5,356,633) and Martin et al. (U.S. Pat. No. 5,213,804 and European Patent No. EP 0 496 813 B1). Liposomes comprising a number of other lipid-polymer conjugates are disclosed in WO 91/05545 and U.S. Pat. No. 5,225,212 (both to Martin et al.) and in WO 94/20073 (Zalipsky et al.) Liposomes comprising PEG-modified ceramide lipids are described in WO 96/10391 (Choi et al). U.S. Pat. No. 5,540,935 (Miyazaki et al.) and U.S. Pat. No. 5,556,948 (Tagawa et al.) describe PEG-containing liposomes that can be further derivatized with functional moieties on their surfaces.

Liposomes and other nanoparticles have also been designed which contain specific targeting molecules. Targeting molecules used for siRNA delivery in vivo have included integrin-binding RGD peptides [Schiffelers et al. (2004) *Nucleic Acids Research* 32:e149], anisamide [Li and Huang (2006) *Molecular Pharmaceutics* 3:579-588] and folate [Hu-Lieskovan et al. (2005) *Cancer Research* 65:8984-8992]. For delivery to myeloid and dendritic cells which are presumed to be important in early Ebola infection, incorporation of targeting agents such as mannose and folate into liposomes and nanoparticles may improve both siRNA delivery and therapeutic effect. Mannose-conjugated oligonucleotides have been shown to specifically improve delivery to myeloid cells [Rojanasakul et al. (1997) *Journal of Biological Chemistry* 272:3910-3914; Diebold et al (2002) *Somatic Cell and Molecular Genetics* 27:65-73] and mannosylated liposomes are effective targeting agents in vivo [Diebold et al. (2002) *Somatic Cell and Molecular Genetics* 27:65-73; Hattori et al. (2006) *Journal Gene Medicine* 8:824-834; Hattori et al. (2006) *Journal of Pharmacology and Experimental Therapeutics* 318:828-834]. Folate conjugation has proven an effective delivery vehicle in a wide variety of contexts [reviewed in Hilgenbrink and Low (2005) *Journal Pharmaceutical Sciences* 94:2135-2146] and incorporation of folate into liposomes is possible using commercially available reagents such as DSPE-PEG(2000)Folate (Avanti Polar Lipids, Alabaster, Ala.). A limited number of liposomes comprising nucleic acids are known in the art. WO 96/40062 to Thierry et al. discloses methods for encapsulating high molecular weight nucleic acids in liposomes. U.S. Pat. No. 5,264,221 to Tagawa et al. discloses protein-bonded liposomes and asserts that the contents of such liposomes may include an dsRNA RNA. U.S. Pat. No. 5,665,710 to Rahman et al. describes certain methods of encapsulating oligodeoxynucleotides in liposomes. WO 97/04787 to Love et al. discloses liposomes comprising dsRNA targeted to the raf gene.

Transfersomes are yet another type of liposomes, and are highly deformable lipid aggregates which are attractive candidates for drug delivery vehicles. Transfersomes may be described as lipid droplets which are so highly deformable that they are easily able to penetrate through pores which are smaller than the droplet. Transfersomes are adaptable to the environment in which they are used, e.g. they are self-optimizing (adaptive to the shape of pores in the skin), selfrepairing, frequently reach their targets without fragmenting, and often self-loading. To make transfersomes it is possible to add surface edge-activators, usually surfactants, to a standard liposomal composition. Transfersomes have been used to deliver serum albumin to the skin. The transfersome-mediated delivery of serum albumin has been shown to be as effective as subcutaneous injection of a solution containing serum albumin.

Surfactants find wide application in formulations such as emulsions (including microemulsions) and liposomes. The most common way of classifying and ranking the properties of the many different types of surfactants, both natural and synthetic, is by the use of the hydrophile/lipophile balance (HLB). The nature of the hydrophilic group (also known as the "head") provides the most useful means for categorizing the different surfactants used in formulations (Rieger, in Pharmaceutical Dosage Forms, Marcel Dekker, Inc., New York, N.Y., 1988, p. 285).

If the surfactant molecule is not ionized, it is classified as a nonionic surfactant. Nonionic surfactants find wide application in pharmaceutical and cosmetic products and are usable over a wide range of pH values. In general their HLB values range from 2 to about 18 depending on their structure. Nonionic surfactants include nonionic esters such as ethylene glycol esters, propylene glycol esters, glyceryl esters, polyglyceryl esters, sorbitan esters, sucrose esters, and ethoxylated esters. Nonionic alkanolamides and ethers such as fatty alcohol ethoxylates, propoxylated alcohols, and ethoxylated/propoxylated block polymers are also included in this class. The polyoxyethylene surfactants are the most popular members of the nonionic surfactant class.

If the surfactant molecule carries a negative charge when it is dissolved or dispersed in water, the surfactant is classified as anionic. Anionic surfactants include carboxylates such as soaps, acyl lactylates, acyl amides of amino acids, esters of sulfuric acid such as alkyl sulfates and ethoxylated alkyl sulfates, sulfonates such as alkyl benzene sulfonates, acyl isethionates, acyl taurates and sulfosuccinates, and phosphates. The most important members of the anionic surfactant class are the alkyl sulfates and the soaps.

If the surfactant molecule carries a positive charge when it is dissolved or dispersed in water, the surfactant is classified as cationic. Cationic surfactants include quaternary ammonium salts and ethoxylated amines. The quaternary ammonium salts are the most used members of this class.

If the surfactant molecule has the ability to carry either a positive or negative charge, the surfactant is classified as amphoteric. Amphoteric surfactants include acrylic acid derivatives, substituted alkylamides, N-alkylbetaines and phosphatides.

The use of surfactants in drug products, formulations and in emulsions has been reviewed (Rieger, in Pharmaceutical Dosage Forms, Marcel Dekker, Inc., New York, N.Y., 1988, p. 285).

Agents that enhance uptake of dsRNAs at the cellular level may also be added to the pharmaceutical and other compositions of the present invention. For example, cationic lipids, such as lipofectin (Junichi et al, U.S. Pat. No. 5,705,188), cationic glycerol derivatives, and polycationic molecules, such as polylysine (Lollo et al., PCT Application WO 97/30731), are also known to enhance the cellular uptake of dsRNAs.

Other agents may be utilized to enhance the penetration of the administered nucleic acids, including glycols such as ethylene glycol and propylene glycol, pyrrols such as 2-pyrrol, azones, and terpenes such as limonene and menthone.

Carriers

Certain compositions of the present invention also incorporate carrier compounds in the formulation. As used herein, "carrier compound" or "carrier" can refer to a nucleic acid, or analog thereof, which is inert (i.e., does not possess biological activity per se) but is recognized as a nucleic acid by in vivo processes that reduce the bioavailability of a nucleic acid having biological activity by, for example, degrading the biologically active nucleic acid or promoting its removal from circulation. The coadministration of a nucleic acid and a carrier compound, typically with an excess of the latter substance, can result in a substantial reduction of the amount of nucleic acid recovered in the liver, kidney or other extracirculatory reservoirs, presumably due to competition between the carrier compound and the nucleic acid for a common receptor. For example, the recovery of a partially phosphorothioate dsRNA in hepatic tissue can be reduced when it is coadministered with polyinosinic acid, dextran sulfate, polycytidic acid or 4-acetamido-4'isothiocyano-stilbene-2,2'-disulfonic acid (Miyao et al., DsRNA Res. Dev., 1995, 5, 115-121; Takakura et al., DsRNA & Nucl. Acid Drug Dev., 1996, 6, 177-183.

Excipients

In contrast to a carrier compound, a "pharmaceutical carrier" or "excipient" is a pharmaceutically acceptable solvent, suspending agent or any other pharmacologically inert vehicle for delivering one or more nucleic acids to an animal. The excipient may be liquid or solid and is selected, with the planned manner of administration in mind, so as to provide for the desired bulk, consistency, etc., when combined with a nucleic acid and the other components of a given pharmaceutical composition. Typical pharmaceutical carriers include, but are not limited to, binding agents (e.g., pregelatinized maize starch, polyvinylpyrrolidone or hydroxypropyl methylcellulose, etc.); fillers (e.g., lactose and other sugars, microcrystalline cellulose, pectin, gelatin, calcium sulfate, ethyl cellulose, polyacrylates or calcium hydrogen phosphate, etc.); lubricants (e.g., magnesium stearate, talc, silica, colloidal silicon dioxide, stearic acid, metallic stearates, hydrogenated vegetable oils, corn starch, polyethylene glycols, sodium benzoate, sodium acetate, etc.); disintegrants (e.g., starch, sodium starch glycolate, etc.); and wetting agents (e.g., sodium lauryl sulphate, etc).

Pharmaceutically acceptable organic or inorganic excipient suitable for non-parenteral administration which do not deleteriously react with nucleic acids can also be used to formulate the compositions of the present invention. Suitable pharmaceutically acceptable carriers include, but are not limited to, water, salt solutions, alcohols, polyethylene glycols, gelatin, lactose, amylose, magnesium stearate, talc, silicic acid, viscous paraffin, hydroxymethylcellulose, polyvinylpyrrolidone and the like.

Suitable pharmaceutically acceptable excipients include, but are not limited to, water, salt solutions, alcohol, polyethylene glycols, gelatin, lactose, amylose, magnesium stearate, talc, silicic acid, viscous paraffin, hydroxymethylcellulose, polyvinylpyrrolidone and the like.

Other Components

The compositions of the present invention may additionally contain other adjunct components conventionally found in pharmaceutical compositions, at their art-established usage levels. Thus, for example, the compositions may contain additional, compatible, pharmaceutically-active materials such as, for example, antipruritics, astringents, local anesthetics or anti-inflammatory agents, or may contain additional materials useful in physically formulating various dosage forms of the compositions of the present invention, such as dyes, flavoring agents, preservatives, antioxidants, opacifiers, thickening agents and stabilizers. However, such materials, when added, should not unduly interfere with the biological activities of the components of the compositions of the present invention. The formulations can be sterilized and, if desired, mixed with auxiliary agents, e.g., lubricants, preservatives, stabilizers, wetting agents, emulsifiers, salts for influencing osmotic pressure, buffers, colorings, flavorings and/or aromatic substances and the like which do not deleteriously interact with the nucleic acid(s) of the formulation.

Aqueous suspensions may contain substances which increase the viscosity of the suspension including, for example, sodium carboxymethylcellulose, sorbitol and/or dextran. The suspension may also contain stabilizers.

Certain embodiments of the invention provide pharmaceutical compositions containing (a) one or more antisense compounds and (b) one or more other chemotherapeutic agents which function by a non-antisense mechanism. Examples of such chemotherapeutic agents include but are not limited to daunorubicin, daunomycin, dactinomycin, doxorubicin, epirubicin, idarubicin, esorubicin, bleomycin, mafosfamide, ifosfamide, cytosine arabinoside, bis-chloroethylnitrosurea, busulfan, mitomycin C, actinomycin D, mithramycin, prednisone, hydroxyprogesterone, testosterone, tamoxifen, dacarbazine, procarbazine, hexamethylmelamine, pentamethylmelamine, mitoxantrone, amsacrine, chlorambucil, methylcyclohexylnitrosurea, nitrogen mustards, melphalan, cyclophosphamide, 6-mercaptopurine, 6-thioguanine, cytarabine, 5-azacytidine, hydroxyurea, deoxycoformycin, 4-hydroxyperoxycyclophosphoramide, 5-fluorouracil (5-FU), 5-fluorodeoxyuridine (5-FUdR), methotrexate (MTX), colchicine, taxol, vincristine, vinblastine, etoposide (VP-16), trimetrexate, irinotecan, topotecan, gemcitabine, teniposide, cisplatin and diethylstilbestrol (DES). See, generally, The Merck Manual of Diagnosis and Therapy, 15th Ed. 1987, pp. 1206-1228, Berkow et al., eds., Rahway, N.J. When used with the compounds of the invention, such chemotherapeutic agents may be used individually (e.g., 5-FU and oligonucleotide), sequentially (e.g., 5-FU and oligonucleotide for a period of time followed by MTX and oligonucleotide), or in combination with one or more other such chemotherapeutic agents (e.g., 5-FU, MTX and oligonucleotide, or 5-FU, radiotherapy and oligonucleotide). Anti-inflammatory drugs, including but not limited to nonsteroidal anti-inflammatory drugs and corticosteroids, and antiviral drugs, including but not limited to ribivirin, vidarabine, acyclovir and ganciclovir, may also be combined in compositions of the invention. See, generally, The Merck Manual of Diagnosis and Therapy, 15th Ed., Berkow et al., eds., 1987, Rahway, N.J., pages 2499-2506 and 46-49, respectively). Other non-antisense chemotherapeutic agents are also within the scope of this invention. Two or more combined compounds may be used together or sequentially.

Toxicity and therapeutic efficacy of such compounds can be determined by standard pharmaceutical procedures in cell cultures or experimental animals, e.g., for determining the LD50 (the dose lethal to 50% of the population) and the ED50 (the dose therapeutically effective in 50% of the population). The dose ratio between toxic and therapeutic effects is the therapeutic index and it can be expressed as the ratio LD50/ED50. Compounds which exhibit high therapeutic indices are preferred.

The data obtained from cell culture assays and animal studies can be used in formulation a range of dosage for use in humans. The dosage of compositions of the invention lies generally within a range of circulating concentrations that include the ED50 with little or no toxicity. The dosage may vary within this range depending upon the dosage form employed and the route of administration utilized. For any compound used in the method of the invention, the therapeutically effective dose can be estimated initially from cell culture assays. A dose may be formulated in animal models to achieve a circulating plasma concentration range of the compound or, when appropriate, of the polypeptide product of a target sequence (e.g., achieving a decreased concentration of the polypeptide) that includes the IC50 (i.e., the concentration of the test compound which achieves a half-maximal inhibition of symptoms) as determined in cell culture. Such information can be used to more accurately determine useful doses in humans. Levels in plasma may be measured, for example, by high performance liquid chromatography.

In addition to their administration individually or as a plurality, as discussed above, the dsRNAs of the invention can be administered in combination with other known agents effective in treatment of pathological processes mediated by Ebola expression. In any event, the administering physician can adjust the amount and timing of dsRNA administration on the basis of results observed using standard measures of efficacy known in the art or described herein.

Methods for Treating Diseases Caused by Infection with the Ebola Virus

The invention relates in particular to the use of a dsRNA or a pharmaceutical composition prepared therefrom for the treatment or prevention of pathological conditions associated with Ebola infection, e.g., systemic hemorrhage and multi-organ failure.

The invention furthermore relates to the use of an dsRNA or a pharmaceutical composition thereof for treating systemic hemorrhage and multi-organ failure in combination with other pharmaceuticals and/or other therapeutic methods, e.g., with known pharmaceuticals and/or known therapeutic methods, such as, for example, those which are currently employed for treating viral infection and systemic hemorrhage. Preference is given to a combination with interferon or other antiviral agents.

Methods for Inhibiting Expression of a Gene from the Ebola Virus

In yet another aspect, the invention provides a method for inhibiting the expression of a gene from the Ebola virus in a mammal. The method comprises administering a composition of the invention to the mammal such that expression of the target Ebola genome is silenced. Because of their high specificity, the dsRNAs of the invention specifically target RNAs (primary or processed) of the target Ebola gene. Compositions and methods for inhibiting the expression of these Ebola genes using dsRNAs can be performed as described elsewhere herein.

In one embodiment, the method comprises administering a composition comprising a dsRNA, wherein the dsRNA comprises a nucleotide sequence which is complementary to at least a part of an RNA transcript of a gene from the Ebola virus, to the mammal to be treated. When the organism to be treated is a mammal such as a human, the composition may be administered by any means known in the art including, but not limited to oral or parenteral routes, including intravenous, intraperitoneal, intramuscular, subcutaneous, transdermal, airway (aerosol), nasal, administration. In some embodiments, the compositions are administered by intravenous infusion or injection.

Unless otherwise defined, all technical and scientific terms used herein have the same meaning as commonly understood by one of ordinary skill in the art to which this invention belongs. Although methods and materials similar or equivalent to those described herein can be used in the practice or testing of the invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

EXAMPLES

Example 1

DsRNA Synthesis

Source of Reagents

Where the source of a reagent is not specifically given herein, such reagent may be obtained from any supplier of reagents for molecular biology at a quality/purity standard for application in molecular biology.

siRNA Synthesis

Single-stranded RNAs were produced by solid phase synthesis on a scale of 1 µmole using an Expedite 8909 synthesizer (Applied Biosystems, Applera Deutschland GmbH, Darmstadt, Germany) and controlled pore glass (CPG, 500 Å, Proligo Biochemie GmbH, Hamburg, Germany) as solid support. RNA and RNA containing 2'-O-methyl nucleotides were generated by solid phase synthesis employing the corresponding phosphoramidites and 2'-O-methyl phosphoramidites, respectively (Proligo Biochemie GmbH, Hamburg, Germany). These building blocks were incorporated at selected sites within the sequence of the oligoribonucleotide chain using standard nucleoside phosphoramidite chemistry such as described in Current protocols in nucleic acid chemistry, Beaucage, S. L. et al. (Edrs.), John Wiley & Sons, Inc., New York, N.Y., USA. Phosphorothioate linkages were introduced by replacement of the iodine oxidizer solution with a solution of the Beaucage reagent (Chruachem Ltd, Glasgow, UK) in acetonitrile (1%). Further ancillary reagents were obtained from Mallinckrodt Baker (Griesheim, Germany).

Deprotection and purification of the crude oligoribonucleotides by anion exchange HPLC were carried out according to established procedures. Yields and concentrations were determined by UV absorption of a solution of the respective RNA at a wavelength of 260 nm using a spectral photometer (DU 640B, Beckman Coulter GmbH, Unterschleißheim, Germany). Double stranded RNA was generated by mixing an equimolar solution of complementary strands in annealing buffer (20 mM sodium phosphate, pH 6.8; 100 mM sodium chloride), heated in a water bath at 85-90° C. for 3 minutes and cooled to room temperature over a period of 3-4 hours. The annealed RNA solution was stored at −20° C. until use.

For the synthesis of 3'-cholesterol-conjugated siRNAs (herein referred to as -Chol-3'), an appropriately modified solid support was used for RNA synthesis. The modified solid support was prepared as follows:

Diethyl-2-azabutane-1,4-dicarboxylate AA

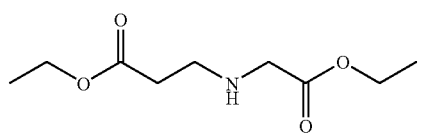

A 4.7 M aqueous solution of sodium hydroxide (50 mL) was added into a stirred, ice-cooled solution of ethyl glycinate hydrochloride (32.19 g, 0.23 mole) in water (50 mL). Then, ethyl acrylate (23.1 g, 0.23 mole) was added and the mixture was stirred at room temperature until completion of the reaction was ascertained by TLC. After 19 h the solution was partitioned with dichloromethane (3×100 mL). The organic layer was dried with anhydrous sodium sulfate, filtered and evaporated. The residue was distilled to afford AA (28.8 g, 61%).

3-{Ethoxycarbonylmethyl-[6-(9H-fluoren-9-yl-methoxycarbonyl-amino)-hexanoyl]-amino}-propionic Acid Ethyl Ester AB

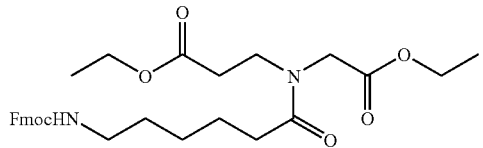

Fmoc-6-amino-hexanoic acid (9.12 g, 25.83 mmol) was dissolved in dichloromethane (50 mL) and cooled with ice. Diisopropylcarbodiimde (3.25 g, 3.99 mL, 25.83 mmol) was added to the solution at 0° C. It was then followed by the addition of Diethyl-azabutane-1,4-dicarboxylate (5 g, 24.6 mmol) and dimethylamino pyridine (0.305 g, 2.5 mmol). The solution was brought to room temperature and stirred further for 6 h. Completion of the reaction was ascertained by TLC. The reaction mixture was concentrated under vacuum and ethyl acetate was added to precipitate diisopropyl urea. The suspension was filtered. The filtrate was washed with 5% aqueous hydrochloric acid, 5% sodium bicarbonate and water. The combined organic layer was dried over sodium sulfate and concentrated to give the crude product which was purified by column chromatography (50% EtOAC/Hexanes) to yield 11.87 g (88%) of AB.

3-[(6-Amino-hexanoyl)-ethoxycarbonylmethyl-amino]-propionic Acid Ethyl Ester AC

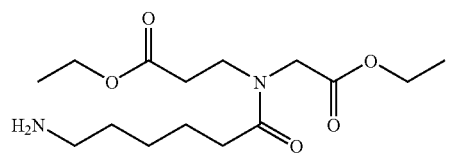

3-{Ethoxycarbonylmethyl-[6-(9H-fluoren-9-ylmethoxycarbonylamino)-hexanoyl]-amino}-propionic acid ethyl ester AB (11.5 g, 21.3 mmol) was dissolved in 20% piperidine in dimethylformamide at 0° C. The solution was continued stirring for 1 h. The reaction mixture was concentrated under vacuum, water was added to the residue, and the product was extracted with ethyl acetate. The crude product was purified by conversion into its hydrochloride salt.

3-({6-[17-(1,5-Dimethyl-hexyl)-10,13-dimethyl-2,3,4,7,8,9,10,11,12,13,14,15,16,17-tetradecahydro-1H-cyclopenta[a]phenanthren-3-yloxycarbonylamino]-hexanoyl}ethoxycarbonylmethyl-amino)-propionic Acid Ethyl Ester AD

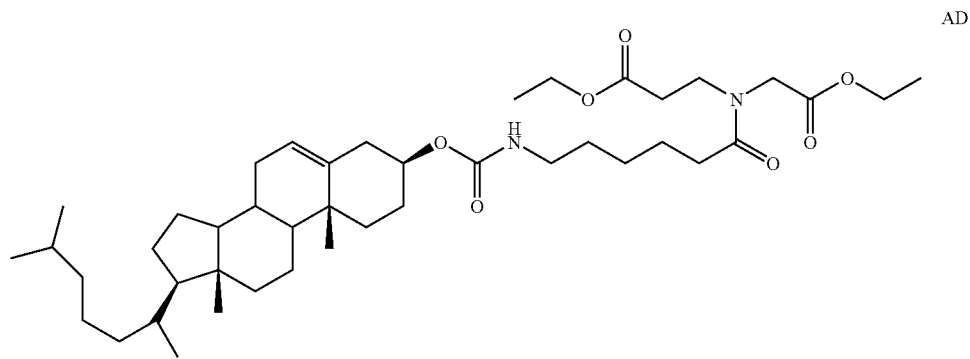

The hydrochloride salt of 3-[(6-Amino-hexanoyl)-ethoxycarbonylmethyl-amino]-propionic acid ethyl ester AC (4.7 g, 14.8 mmol) was taken up in dichloromethane. The suspension was cooled to 0° C. on ice. To the suspension diisopropylethylamine (3.87 g, 5.2 mL, 30 mmol) was added. To the resulting solution cholesteryl chloroformate (6.675 g, 14.8 mmol) was added. The reaction mixture was stirred overnight. The reaction mixture was diluted with dichloromethane and washed with 10% hydrochloric acid. The product was purified by flash chromatography (10.3 g, 92%).

1-{6-[17-(1,5-Dimethyl-hexyl)-10,13-dimethyl-2,3,4,7,8,9,10,11,12,13,14,15,16,17-tetradecahydro-1H-cyclopenta[a]phenanthren-3-yloxycarbonylamino]-hexanoyl}-4-oxo-pyrrolidine-3-carboxylic Acid Ethyl Ester AE

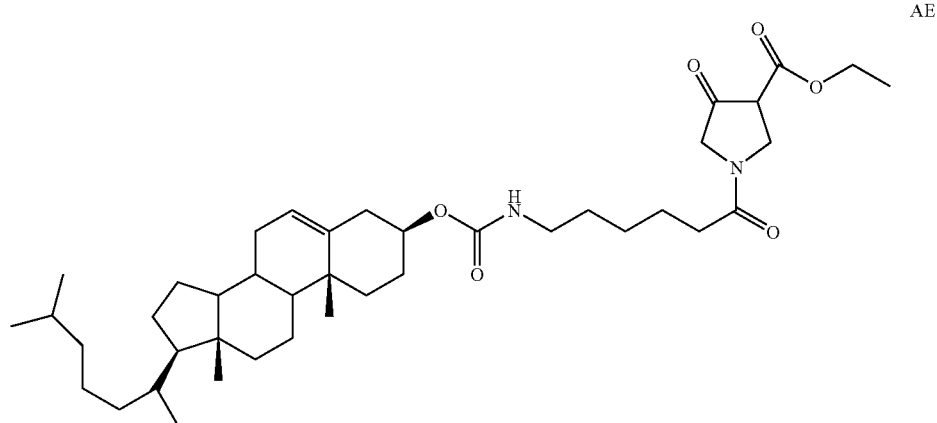

Potassium t-butoxide (1.1 g, 9.8 mmol) was slurried in 30 mL of dry toluene. The mixture was cooled to 0° C. on ice and 5 g (6.6 mmol) of diester AD was added slowly with stirring within 20 mins. The temperature was kept below 5° C. during the addition. The stirring was continued for 30 mins at 0° C. and 1 mL of glacial acetic acid was added, immediately followed by 4 g of $NaH_2PO_4.H_2O$ in 40 mL of water The resultant mixture was extracted twice with 100 mL of dichloromethane each and the combined organic extracts were washed twice with 10 mL of phosphate buffer each, dried, and evaporated to dryness. The residue was dissolved in 60 mL of toluene, cooled to 0° C. and extracted with three 50 mL portions of cold pH 9.5 carbonate buffer. The aqueous extracts were adjusted to pH 3 with phosphoric acid, and extracted with five 40 mL portions of chloroform which were combined, dried and evaporated to dryness. The residue was purified by column chromatography using 25% ethylacetate/hexane to afford 1.9 g of b-ketoester (39%).

[6-(3-Hydroxy-4-hydroxymethyl-pyrrolidin-1-yl)-6-oxo-hexyl]-carbamic acid 17-(1,5-dimethyl-hexyl)-10,13-dimethyl-2,3,4,7,8,9,10,11,12,13,14,15,16,17-tetradecahydro-1H-cyclopenta[a]phenanthren-3-yl Ester AF

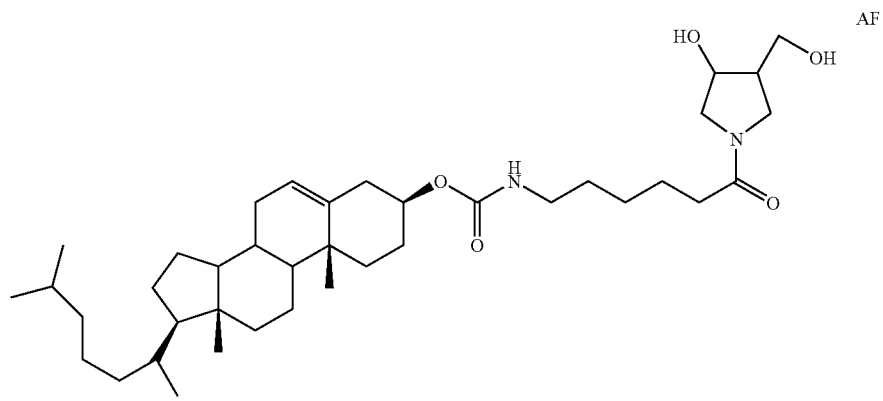

Methanol (2 mL) was added dropwise over a period of 1 h to a refluxing mixture of b-ketoester AE (1.5 g, 2.2 mmol) and sodium borohydride (0.226 g, 6 mmol) in tetrahydrofuran (10 mL). Stirring was continued at reflux temperature for 1 h. After cooling to room temperature, 1 N HCl (12.5 mL) was added, the mixture was extracted with ethylacetate (3×40 mL). The combined ethylacetate layer was dried over anhydrous sodium sulfate and concentrated under vacuum to yield the product which was purified by column chromatography (10% $MeOH/CHCl_3$) (89%).

(6-{3-[Bis-(4-methoxy-phenyl)-phenyl-methoxymethyl]-4-hydroxy-pyrrolidin-1-yl}-6-oxo-hexyl)-carbamic acid 17-(1,5-dimethyl-hexyl)-10,13-dimethyl-2,3,4,7,8,9,10,11,12,13,14,15,16,17-tetradecahydro-1H-cyclopenta[a]phenanthren-3-yl Ester AG

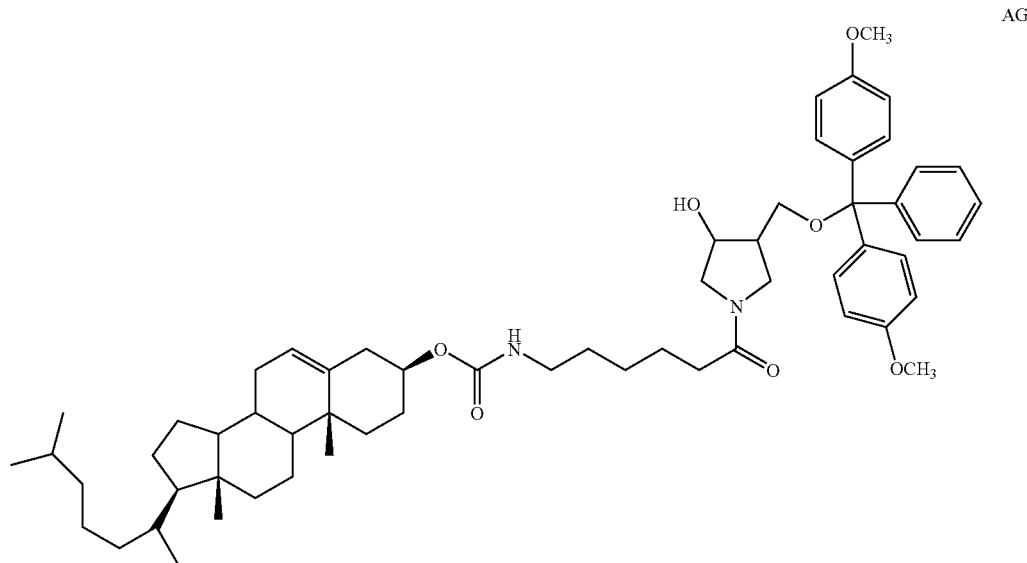

Diol AF (1.25 gm 1.994 mmol) was dried by evaporating with pyridine (2×5 mL) in vacuo. Anhydrous pyridine (10 mL) and 4,4'-dimethoxytritylchloride (0.724 g, 2.13 mmol) were added with stirring. The reaction was carried out at room temperature overnight. The reaction was quenched by the addition of methanol. The reaction mixture was concentrated under vacuum and to the residue dichloromethane (50 mL) was added. The organic layer was washed with 1M aqueous sodium bicarbonate. The organic layer was dried over anhydrous sodium sulfate, filtered and concentrated. The residual pyridine was removed by evaporating with toluene. The crude product was purified by column chromatography (2% MeOH/Chloroform, Rf=0.5 in 5% MeOH/CHCl$_3$) (1.75 g, 95%).

Succinic Acid mono-(4-[bis-(4-methoxy-phenyl)-phenyl-methoxymethyl]-1-{6-[17-(1,5-dimethyl-hexyl)-10,13-dimethyl 2,3,4,7,8,9,10,11,12,13,14,15,16,17-tetradecahydro-1H cyclopenta[a]phenanthren-3-yloxycarbonylamino]-hexanoyl}-pyrrolidin-3-yl) Ester AH

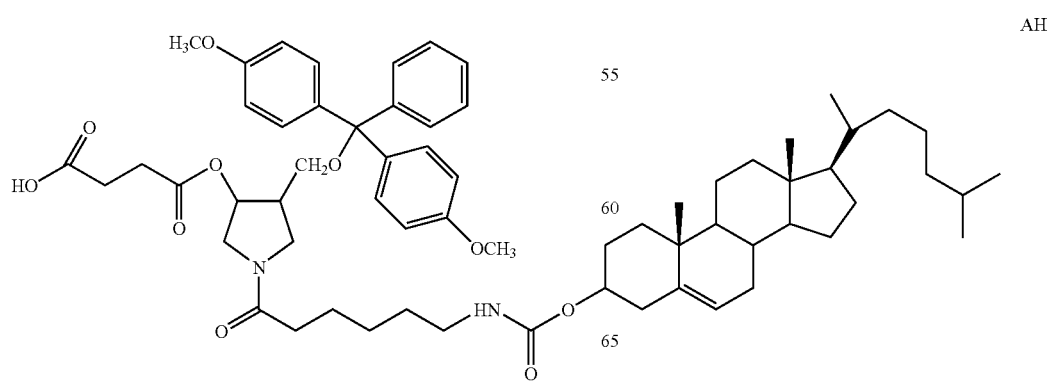

Compound AG (1.0 g, 1.05 mmol) was mixed with succinic anhydride (0.150 g, 1.5 mmol) and DMAP (0.073 g, 0.6 mmol) and dried in a vacuum at 40° C. overnight. The mixture was dissolved in anhydrous dichloroethane (3 mL), triethylamine (0.318 g, 0.440 mL, 3.15 mmol) was added and the solution was stirred at room temperature under argon atmosphere for 16 h. It was then diluted with dichloromethane (40 mL) and washed with ice cold aqueous citric acid (5 wt %, 30 mL) and water (2×20 mL). The organic phase was dried over anhydrous sodium sulfate and concentrated to dryness. The residue was used as such for the next step.

Cholesterol Derivatised CPG AI

AI

TABLE 1

Abbreviations of nucleotide monomers used in nucleic acid sequence representation. It will be understood that these monomers, when present in an oligonucleotide, are mutually linked by 5'-3'-phosphodiester bonds.

| Abbreviation | Nucleotide(s) |
| --- | --- |
| A | adenosine-5'-phosphate |
| C | cytidine-5'-phosphate |
| G | guanosine-5'-phosphate |
| T | 2'-deoxy-thymidine-5'-phosphate |
| U | uridine-5'-phosphate |
| N | any nucleotide (G, A, C, or T) |

Succinate AH (0.254 g, 0.242 mmol) was dissolved in a mixture of dichloromethane/acetonitrile (3:2, 3 mL). To that solution DMAP (0.0296 g, 0.242 mmol) in acetonitrile (1.25 mL), 2,2'-Dithio-bis(5-nitropyridine) (0.075 g, 0.242 mmol) in acetonitrile/dichloroethane (3:1, 1.25 mL) were added successively. To the resulting solution triphenylphosphine (0.064 g, 0.242 mmol) in acetonitrile (0.6 ml) was added. The reaction mixture turned bright orange in color. The solution was agitated briefly using a wrist-action shaker (5 mins). Long chain alkyl amine-CPG (LCAA-CPG) (1.5 g, 61 mM) was added. The suspension was agitated for 2 h. The CPG was filtered through a sintered funnel and washed with acetonitrile, dichloromethane and ether successively. Unreacted amino groups were masked using acetic anhydride/pyridine. The achieved loading of the CPG was measured by taking UV measurement (37 mM/g).

The synthesis of siRNAs bearing a 5'-12-dodecanoic acid bisdecylamide group (herein referred to as "5'-C32-") or a 5'-cholesteryl derivative group (herein referred to as "5'-Chol-") was performed as described in WO 2004/065601, except that, for the cholesteryl derivative, the oxidation step was performed using the Beaucage reagent in order to introduce a phosphorothioate linkage at the 5'-end of the nucleic acid oligomer.

Nucleic acid sequences are represented below using standard nomenclature, and specifically the abbreviations of Table 1.

TABLE 1-continued

Abbreviations of nucleotide monomers used in nucleic acid sequence representation. It will be understood that these monomers, when present in an oligonucleotide, are mutually linked by 5'-3'-phosphodiester bonds.

| Abbreviation | Nucleotide(s) |
| --- | --- |
| a | 2'-O-methyladenosine-5'-phosphate |
| c | 2'-O-methylcytidine-5'-phosphate |
| g | 2'-O-methylguanosine-5'-phosphate |
| u | 2'-O-methyluridine-5'-phosphate |
| sT | 2'-deoxy-thymidine-5'phosphate-phosphorothioate |

Example 2

Gene Walking of a Gene from the Ebola Virus

Design and In Silico Selection of siRNAs Targeting Ebola Virus siRNA design was carried out to identify siRNAs targeting Ebola virus mRNAs for genes VP30, VP35, NP, L, VP24, VP40 and GP with a focus on sequences isolated from the Zaire region (EBOV-Z), as well as sequences from Sudan (EBOV-S). The siRNA in silico selection resulted in 521 siRNAs satisfying our selection criteria (Table 2).

Ebola Zaire sequence AY354458 was downloaded from NCBI Nucleotide database and further on used as reference sequence for EBOV-Z. Ebola Sudan sequence AY729654 was used as reference sequence for EBOV-S, respectively.

Sequence regions encoding target genes VP30, VP35, NP, L, VP24, VP40 and GP according to the information in the Genbank file were extracted from both reference sequences, followed by extraction of all possible 19 mers for each gene, resulting in the candidate siRNA target regions (and siRNA sense sequences) for each distinct gene.

In order to identify siRNAs targeting all available EBOV-Z and EBOV-S sequences, it was necessary to compile available Ebola sequences from all sequenced isolates. For this, each of the 7 target gene sequences extracted from the Ebola Zaire reference sequences was used in a blast search against viruses at NCBI with default parameters and resulting Ebola mRNA hits were downloaded.

Each candidate target region was tested for conservation across the Ebola sequences by searching the relevant target gene for presence of the 19 mer target region. The percentage of conserved sequences across all downloaded sequences for the relevant gene was calculated for each candidate target region by dividing of the number of conserved sequences with the total number of downloaded sequences.

Example 3

Ebola siRNA In Vitro Screening

Table 3 provides a summary of the screening results of the siRNAs described in Table 2. Following initial screening using a GFP-expressing Ebola-Zaire virus and immunofluorescence screening using Ebola-Sudan virus, siRNA showing activity were further tested by plaque assay for anti-viral activity against Ebola-Zaire and Ebola-Sudan strains. Several siRNAs were identified that had significant activity against one or more Ebola strains. At a concentration of 100 nM many of the siRNA identified showed greater than a 1 log reduction (>90% inhibition) in Ebola virus titers. Negative control luciferase and GFP siRNA at the same concentration showed reductions in virus titer of between 10 and 35% (Table 3). Three previously identified Ebola siRNA (LS L#1, LS NP#1, LS VP35#1) were also tested in parallel and these inhibited Ebola virus by roughly 70%. The previously identified Ebola siRNA are 25 nucleotide blunt-ended duplexes with the following composition: LS L#1, sense: 5' CCAUCUCUGAGA-CACGACAUAUCUU 3' (SEQ ID NO: 1073) anti-sense: 5' AAGAUAUGUCGUGUCUCAGAGAUGG 3' (SEQ ID NO: 1074); LS NP#1, sense: 5' GGUUCAAAGGCAAAUU-CAAGUACAU 3' (SEQ ID NO: 1075) anti-sense 5' AUGUACUUGAAUUUGCCUUUGAACC 3' (SEQ ID NO: 1076); LS VP35#l, sense 5' CCCAAAUGCAACAAAC-CAAGCCAAA 3' (SEQ ID NO: 1077) anti-sense 5' UUUG-GCUUGGUUUGUUGCAUUUGGG 3' (SEQ ID NO: 1078). The siRNA sequences for AD-1955 and AD-5179 are as follows: AD-1955, sense: 5' CUUACGCUGAGUACU-UCGAdTsdT 3' (SEQ ID NO: 1079) anti-sense: 5' UCGAAGUACUCAGCGUAAGdTsdT 3' (SEQ ID NO: 1080); AD-5179, sense: 5' CcAcAuGAAGcAGcACGACusU 3' (SEQ ID NO: 1081) anti-sense: 5' AAGUCGUGCUGCU-UCAUGUGgsusC 3' (SEQ ID NO: 1082).

Lead siRNAs were also screened for immunostimulatory activity (IFNalpha and TNFalpha). Immunostimulatory activity was assayed by transfecting siRNAs into human peripheral blood mononuclear cells and measuring cytokine release by ELISA as outlined in Hornung et al. Nature Medicine 2005. Cytokine levels were normalized to a positive control siRNA included in every assay. The lead candidates had no immunostimulatory activity.

The following procedures were used in generating the screening results.

GFP Ebola-Zaire Assay

VERO cells were transfected at ~2×10E4 cells per well in a black-walled 96 well plate. Transfection was performed in EMEM with 10% FCS overnight at 100, 10 and 1 nM siRNA complexed with lipofectamine (1.2 ul of lipofectamine per well in 50 ul volume; complexation was performed at room temperature for 15-20 min).

Next day cells were infected with GFP-EBOLA virus (1/50 dilution of stock EBOLA-Zaire GFP, stock E6(4) from 11OCT05, USAMRIID) in 50 ul of EMEM with 10% FCS. 2 days later cells were fixed in 10% neutral-buffered formalin for >3 days. Formalin was changed before removing from BSL-4 suite. Next formalin was replaced with PBS.

To quantify infection level of cells in individual wells, cells were stained with 10-20 ul/well of 10 ug/ml Hoescht dye and read on Discovery 1 microscope. GFP signal normalized to Hoescht signal was read as a measure of infection level.

Immunofluorescence Ebola-Sudan Assay

VERO cells were transfected at ~2×10E4 cell per well in a black-walled 96 well plate. Transfection was performed in EMEM with 10% FCS overnight at 100, 10 and 1 nM siRNA complexed with lipofectamine (1.2 ul of lipofectamine per well in 50 ul volume; complexation was performed at room temperature for 15-20 min).

Next day cells were infected with EBOLA-Sudan virus (1/100 dilution of EBOV-Sudan (Boniface), stock GP(1)V(2) E6(2) from 23 May 2006, USAMRIID) in 50 µl of EMEM with 10% FCS. Two days later cells were fixed in 10% neutral-buffered formalin for >3 days. Formalin was changed before removing from BSL-4 suite. Next formalin was replaced with PBS.

To detect infected cells, cells were stained for 4 h at room temperature with mouse anti-Sudan Boniface polyclonal sera (sera was collected from 20 animals and pooled at day 30 post infection of C57BL/6 mice infected with ~1000 pfu of the EBOLA SUDAN-BONIFACE, stock GP(1) V(2) V(1) E6(2) from 23 May 2006, USAMRIID) at 1:200 dilution in PBS. Then cells were washed with PBS 2× for 5 minutes. Goat anti-mouse IgG-AlexaFluor488 (Molecular Probes) was added at 1:500 dilution in PBS. Cells were washed again with PBS for 5 minutes, 100 ul of PBS was added to each well. To quantify infection level of cells in individual wells, cell were stained with 10-20 ul/well of 10 ug/ml Hoescht dye and read on Discovery 1 microscope. AlexaFluor488 signal normalized to Hoescht signal was read as a measure of infection level.

Plaque Assay for Filoviruses for In Vitro Assay

Vero cells were transfected in 24 well plates at the density of ~1.5×10E5/well density. Transfection was performed in EMEM with 10% FCS overnight at 100 nM siRNA complexed with lipofectamine (3 ul of lipofectamine per well in 200 ul volume; complexation was performed at room temperature for 15-20 min). Transfection was done in duplicates. 24 hours later duplicate plates were infected in 50 ul/well with either 1/500 diluted Zaire-EBOV [(E6P2) stock from 20 Jun. 2006, USAMRIID] or 1/1000 diluted EBOV-Sudan [(strain Boniface), stock GP(1)V(2)E6(2) from 23 May 2006, USAMRIID]. After 1 hour at 37° C. virus inoculum was replaced with 500 ul of fresh 10% FCS/EMEM.

48-72 h later supernatants were harvested from each well.

Plaque assay was performed with supernatants at $10^{-1}$, $10^{-2}$, $10^{-3}$, $10^{-4}$, $10^{-5}$ and $10^{-6}$ dilutions. Fresh Vero cells in 6-well plates were infected with diluted supernatants for 1 hour at 37° C. with rocking plates every 15 minutes; overlaid with 2 ml/well of 0.5% agarose in EMEM, 5% FCS, Pen/ Strep. Six days later plates were overlaid with 2 ml of overlay media+4% neutral red solution and read plates the following day.

siRNA Activity Determination Using the Plasmid System.

Consensus sequences of NP (SEQ ID NO: 1043), GP (SEQ ID NO: 1044), L, VP24 (SEQ ID NO: 1045), VP30 (SEQ ID NO:1046), VP35 (SEQ ID NO:1047), VP40 (SEQ ID NO: 1048) were synthesized by GENEART (Regensburg, Germany) and cloned into GENEART standard vector. The L gene was generated as 2 fragments (SEQ ID NO: 1049 and SEQ ID NO: 1050). All genes were subcloned into individual psiCheck-2 (Promega, Mannheim, Germany) vectors via XhoI and NotI sites, resulting in a construct with the flu gene between the stop-codon and the polyA-signal of *Renilla* luciferase. Correct cloning was confirmed by end sequencing performed by GATC Biotech (Konstanz, Germany).

Transfections:

Cos-7 cells were seeded at $1.5 \times 10^4$ cells/well on white 96-well plates with clear bottom (Greiner Bio-One GmbH, Frickenhausen, Germany) in 75 µl of growth medium. Directly after seeding the cells, 50 ng of plasmid/well were transfected with Lipofectamine-2000 (Invitrogen) as described below for the siRNAs, with the plasmid diluted in Opti-MEM to a final volume of 12.5 µl/well, prepared as a mastermix for the whole plate.

siRNA transfections were performed in quadruplicates 4 h after plasmid transfection. For each well 0.5 µl Lipofectamine-2000 (Invitrogen GmbH, Karlsruhe, Germany) were mixed with 12 µl Opti-MEM (Invitrogen) and incubated for 15 min at room temperature. For an siRNA concentration of 50 nM in the 100 µl transfection volume, 1 µl of a 5 µM siRNA were mixed with 11.5 µl Opti-MEM per well, combined with the Lipofectamine-2000-Opti-MEM mixture and again incubated for 15 minutes at room temperature. During incubation, the growth medium was removed from cells and replaced by 75 µl/well of fresh medium. siRNA-Lipofectamine2000-complexes were applied completely (25 µl each per well) to the cells and cells were incubated for 24 h at 37° C. and 5% $CO_2$ in a humidified incubator (Heraeus GmbH, Hanau, Germany).

Cells were harvested by removing growth medium and application of 150 µl of a 1:1 mixture consisting of medium and Dual-Glo Luciferase substrate, from the Dual-Glo Luciferase Assay System (Promega, Mannheim, Germany) .The luciferase assay was performed according to the manufacturer's protocol for Dual-Glo Luciferase assay and luminescence was measured in a Victor-Light 1420 Luminescence Counter (Perkin Elmer, Rodgau-Jügesheim, Germany). Values obtained with *Renilla* luciferase were normalized to the respective values obtained with Firefly luciferase. Values acquired with siRNAs directed against an Ebola gene were normalized to the value obtained with an unspecific siRNA (directed against neomycin resistance gene) set to 100%.

Example 4

In Vivo Filovirus Infection Model

Liposome-formulated siRNAs targeting Ebola genes protected mice from a lethal Ebola virus challenge. Details on the liposome formulation are detailed in the next section. Mice were treated with liposome-formulated siRNA (described below) twice, at 2 hours prior to Ebola infection (5 mg/kg i.v.) and at 3 days after Ebola infection (3 mg/kg i.p.). Mice were infected intraperitoneally with 30,000 LD50 of Ebola-Zaire (LD50 is lethal dose of Ebola infection where 50% of animals die). Mice were monitored for survival with n=10 per treatment group. Negative controls included untreated mice and mice treated with liposome-formulated luciferase siRNA (AD-1955). EK1 is a previously published siRNA sequence targeting the Ebola L gene [Geisbert et al. (2006) *The Journal of Infectious Disease* 193:1950-1657] that was used as a positive control. The siRNA sequences for EK1 are as follows:

```
                                        (SEQ ID NO: 1083)
5' GUACGAAGCUGUAUAUAAAdTdT 3' (sense)
and (SEQ ID NO: 1084)
5' UUUAUAUACAGCUUCGUACdTdT 3' (antisense).
```

FIG. 1 provides the results. All the negative control-treated animals (untreated and liposomally-formulated luciferase siRNA-treated) died within 6-8 days following Ebola infection. Several of the liposomally-formulated Ebola siRNAs showed significant increases in survival rates compared to the negative controls. Multiple Ebola siRNA (AD-11691, AD-11710, AD-11588, AD-11599, AD-11570) showed more protection against lethal Ebola infection than the previously published EK1 siRNA (FIG. 1).

A further experiment was conducted utilizing one of the active Ebola siRNA (AD-11570) to investigate different dosing routes and treatment regimens. Mice were treated with liposome-formulated Ebola VP35 siRNA (AD-11570) or negative control luciferase siRNA (AD-1955) 2 hours prior to Ebola infection (5 mg/kg i.p.). Mice were infected intraperitoneally with 30,000 LD50 of Ebola-Zaire (LD50 is lethal dose of Ebola infection where 50% of animals die). Mice were monitored for survival with n=10 per treatment group.

Figure 2:
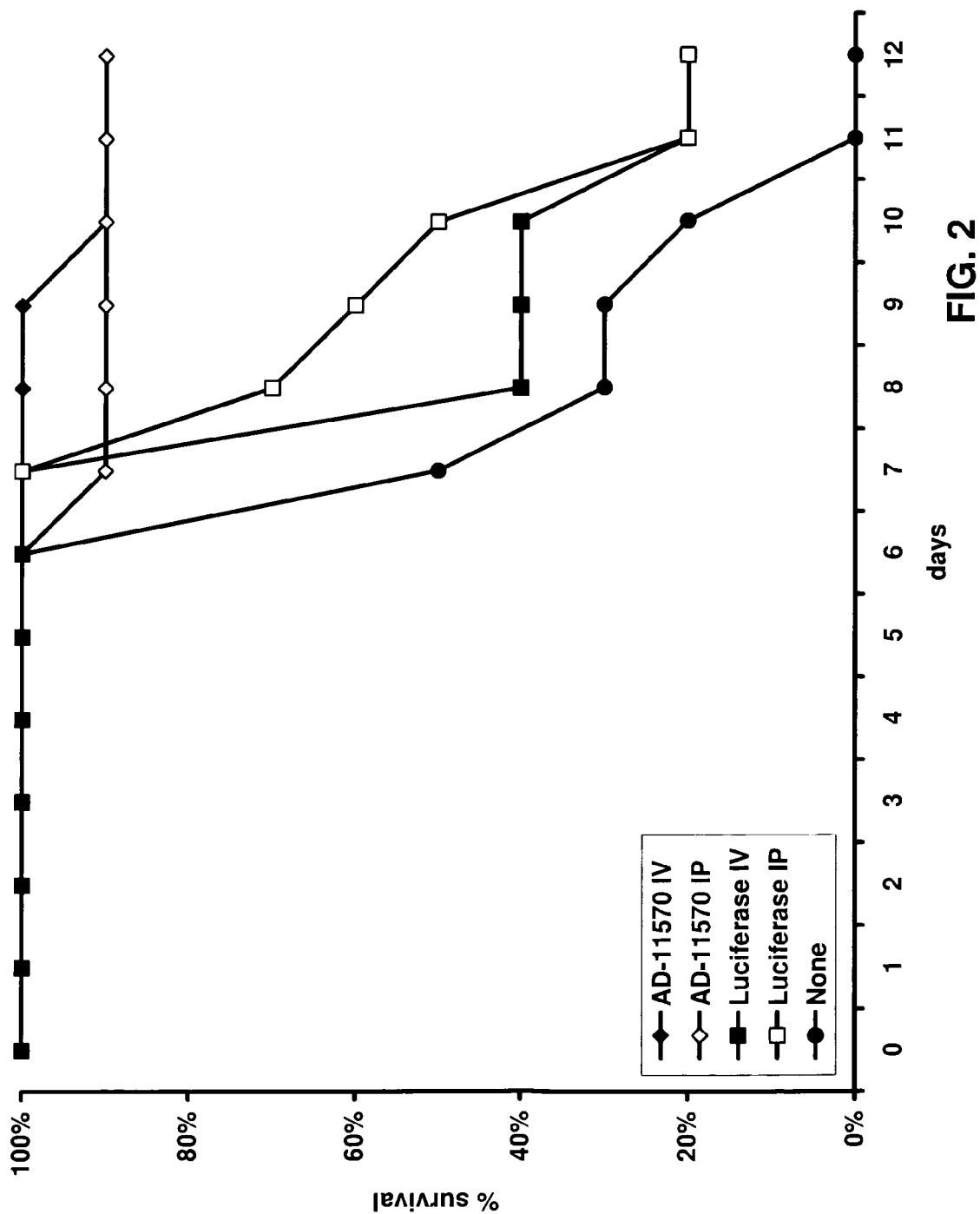
FIG. 2 is a graph showing that a single injection of a liposomally formulated siRNA delivered by ip or iv protected mice from a lethal Ebola challenge. VP35 siRNA was AD-11570

FIG. 2 provides the results. The animals treated with liposomally-formulated AD-11570 showed near complete protection against lethal Ebola infection as compared to the negative control-treated animals (untreated and liposomally-formulated luciferase siRNA-treated) (FIG. 2). These results indicate that a single siRNA administration either via intravenous or intraperitoneal route is able to have a significant impact on survival.

Formulation Procedure

Figure 3:
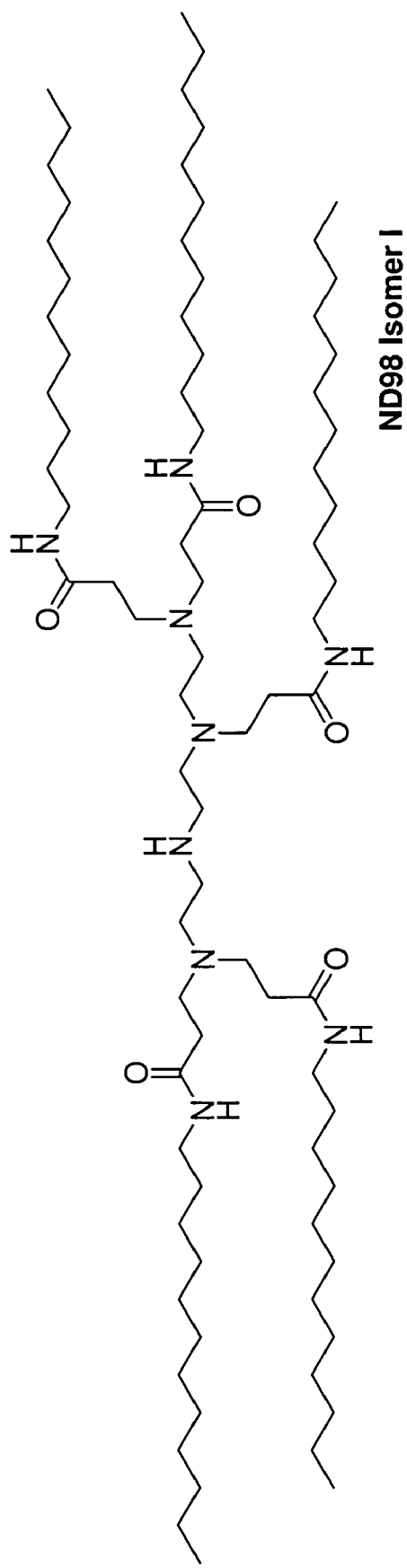
FIG. 3 is the structure of NP98 lipid.

The lipidoid ND98.4HCl (MW 1487) (FIG. 3), Cholesterol (Sigma-Aldrich), and PEG-Ceramide C16 (Avanti Polar Lipids) were used to prepare lipid-siRNA nanoparticles. Stock solutions of each in ethanol were prepared: ND98, 133 mg/mL; Cholesterol, 25 mg/mL, PEG-Ceramide C16, 100 mg/mL. ND98, Cholesterol, and PEG-Ceramide C16 stock solutions were then combined in a 42:48:10 molar ratio. Combined lipid solution was mixed rapidly with aqueous siRNA (in sodium acetate pH 5) such that the final ethanol concentration was 35-45% and the final sodium acetate concentration was 100-300 mM. Lipid-siRNA nanoparticles formed spontaneously upon mixing. Depending on the desired particle size distribution, the resultant nanoparticle mixture was in some cases extruded through a polycarbonate membrane (100 nm cut-off) using a thermobarrel extruder (Lipex Extruder, Northern Lipids, Inc). In other cases, the extrusion step was omitted. Ethanol removal and simultaneous buffer exchange was accomplished by either dialysis or tangential flow filtration. Buffer was exchanged to phosphate buffered saline (PBS) pH 7.2.

Characterization of Formulations

Formulations prepared by either the standard or extrusion-free method are characterized in a similar manner. Formulations are first characterized by visual inspection. They should be whitish translucent solutions free from aggregates or sediment. Particle size and particle size distribution of lipid-nanoparticles are measured by dynamic light scattering using a Malvern Zetasizer Nano ZS (Malvern, USA). Particles should be 20-300 nm, and ideally, 40-100 nm in size. The particle size distribution should be unimodal. The total siRNA concentration in the formulation, as well as the entrapped fraction, is estimated using a dye exclusion assay. A sample of the formulated siRNA is incubated with the RNA-binding dye Ribogreen (Molecular Probes) in the presence or absence of a formulation disrupting surfactant, 0.5% Triton-X100. The total siRNA in the formulation is determined by the signal from the sample containing the surfactant, relative to a standard curve. The entrapped fraction is determined by subtracting the "free" siRNA content (as measured by the signal in the absence of surfactant) from the total siRNA content. Percent entrapped siRNA is typically >85%.

Example 5 siRNAs Targeting Ebola Increased the Life-Span of Mice and Guinea Pigs Infected with Ebola siRNA directed against different Ebola genes were formulated in liposomes. A single dose of siRNA targeting the VP35 gene (AD-11570) protected both mice and guinea pigs against lethal Ebola infection (1000 PFU; 30000×LD50). Protection was associated with reduction in viral titres and was seen when drug was administered either prophylactically or therapeutically. Irrelevant siRNA (targeting luciferase) similarly formulated showed no protective effect or impact on virus titer.

Studies were conducted in mouse, guinea pig, and nonhuman primate lethal Ebola infection models. The studies are summarized below.

Mouse study 1: Demonstrated efficacy in mouse model of Ebola for multiple siRNA sequences formulated in LNP01. siRNAs were administered by intravenous (i.v.) injection on day 0, followed by intraperitoneal (i.p.) injection on day 3. See FIG. 1.

Mouse study 3: Demonstrated efficacy of siRNA in LNP01 formulation in the mouse model of Ebola when given by either IV or IP route. See FIG. 2. Mice were monitored for survival with n=10 per treatment group.

Figure 4:
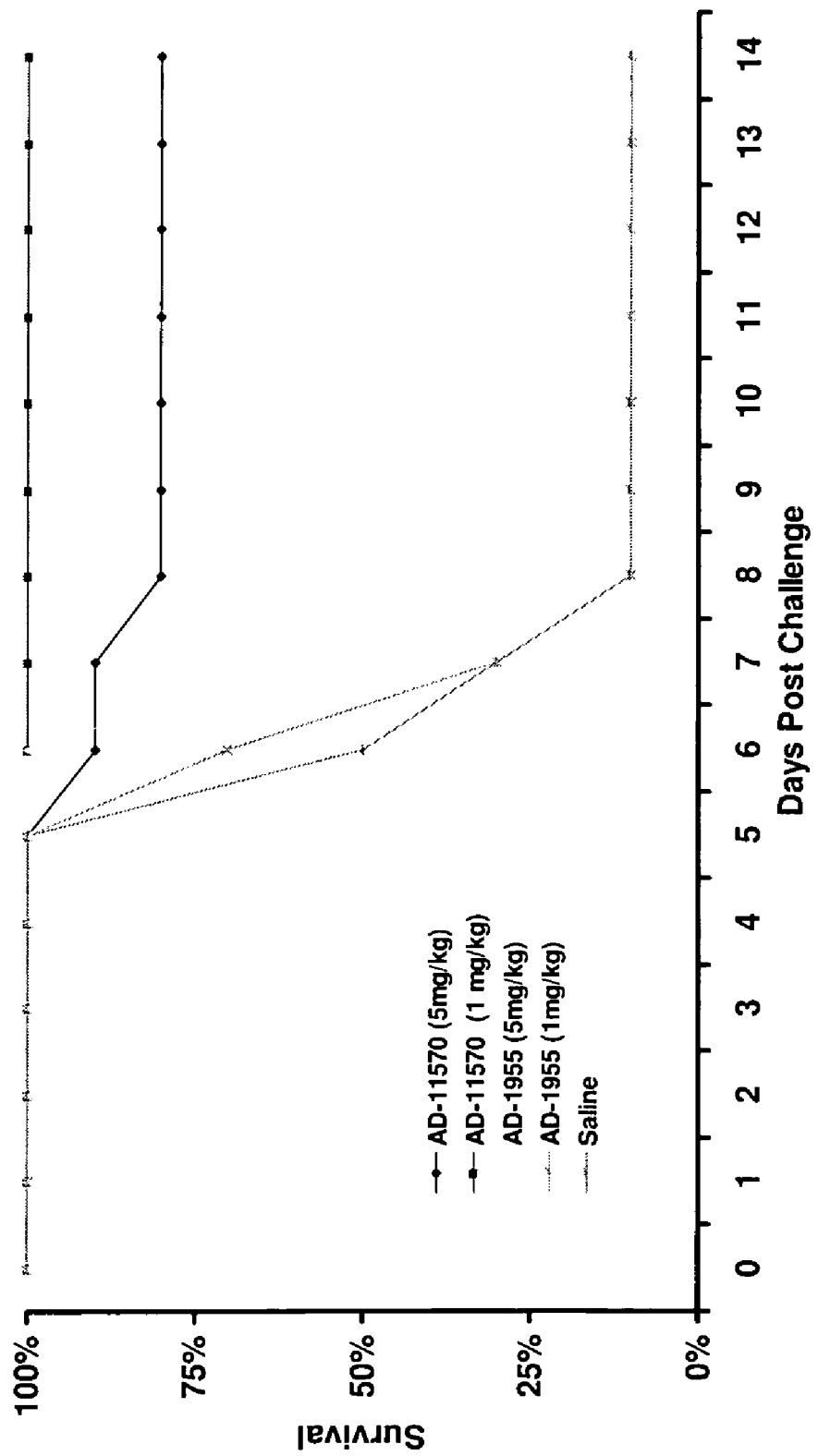
FIG. 4 is a graph showing that siRNAs formulated with DODMA protected mice from a lethal Ebola virus challenge.

Mouse study #14: Demonstrated efficacy of siRNA in DODMA in the mouse model of Ebola by the IP route. See FIG. 4. siRNAs were formulated in DODMA:DSPC:Chol: PEG-DMG. Mice were monitored for survival with n=10 per treatment group. Treatment with 10 mg/kg DODMA-formulated AD-11570 siRNAs was also effective to protect guinea pigs infected with Ebola.

Figure 5:
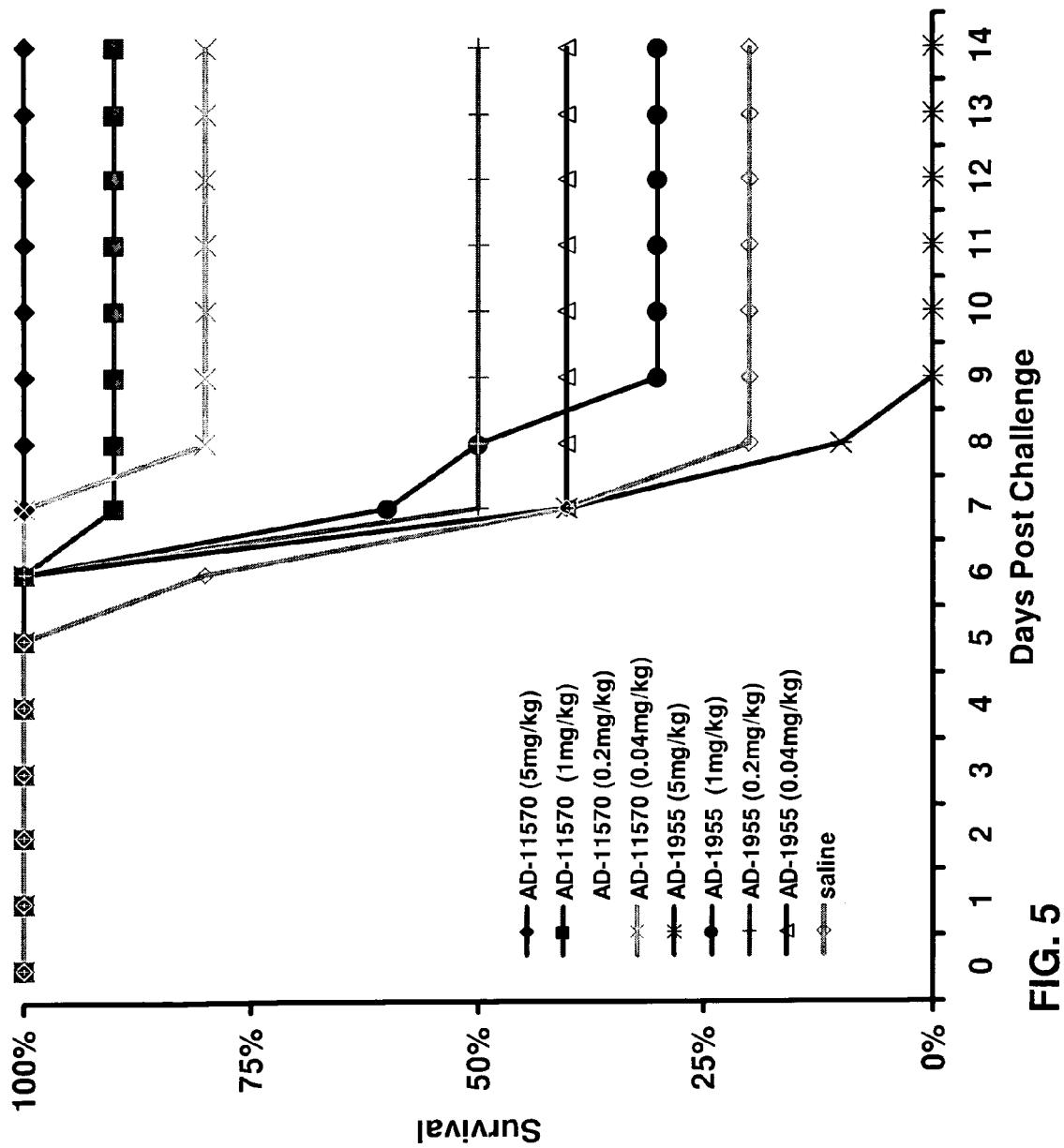
FIG. 5 is a graph showing that siRNAs formulated with DODMA were effective down to 0.04 mg/kg to protect mice injected with Ebola.

Mouse study #15: Demonstrated that siRNA in DODMA formulation is effective down to 0.04 mg/kg in the mouse model of Ebola. AD-11570 consistently gave 25-50% protection, but no clear dose response was seen. The control siRNA AD-1955 gave 25-50% protection, but again, no dose response was observed. See FIG. 5.

Figure 6:
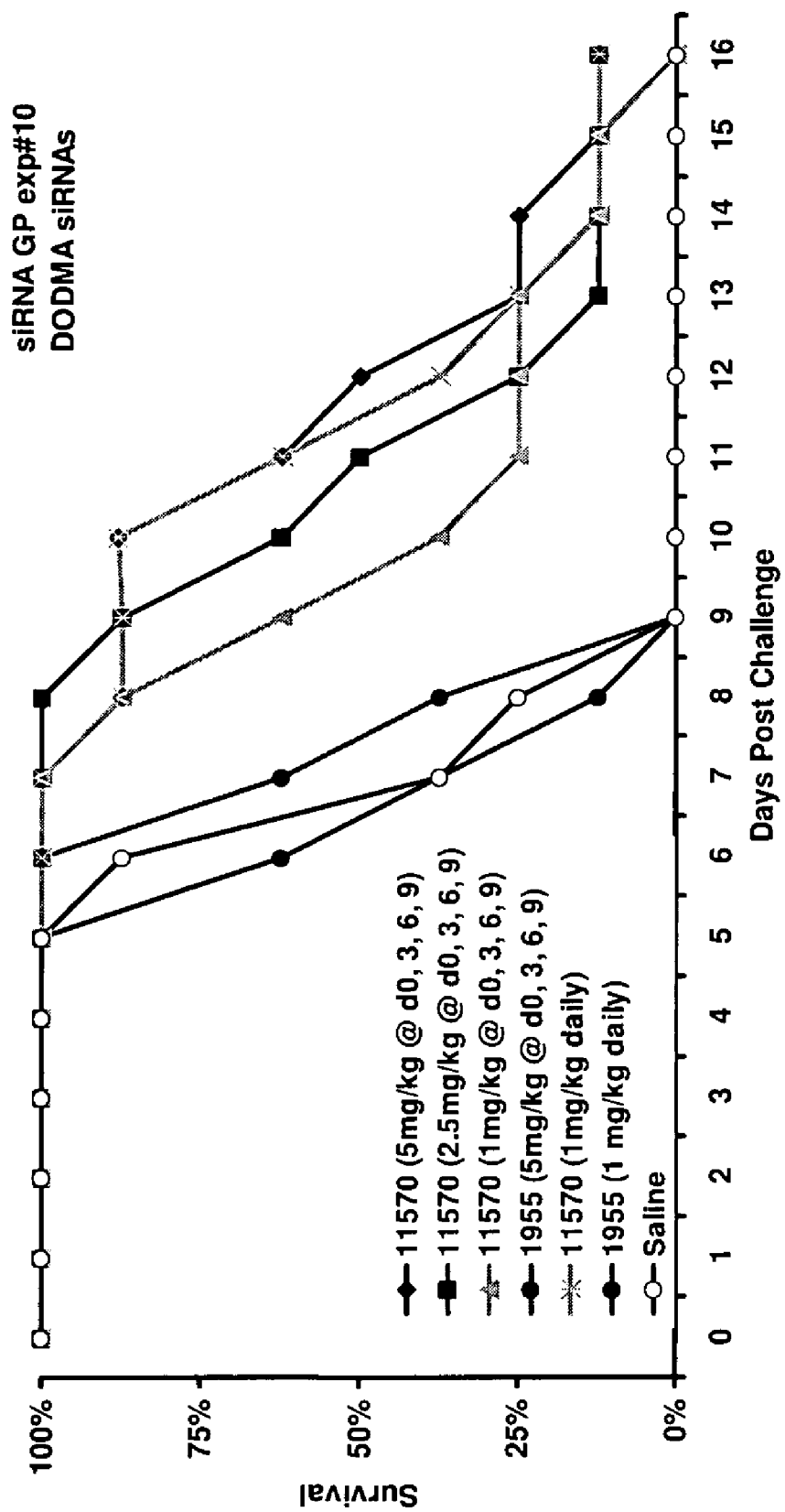
FIG. 6 is a graph showing that siRNAs formulated with DODMA were effective to protect guinea pigs from a lethal Ebola virus challenge.

Guinea pig study #6: Demonstrated efficacy of multiple doses of siRNA in DODMA formulation in the guinea pig model of Ebola. AD-11570 siRNAs formulated in DODMA: DSPC:Chol:PEG-DMG were effective to protect guinea pigs from Ebola. See FIG. 6.

Figure 7:
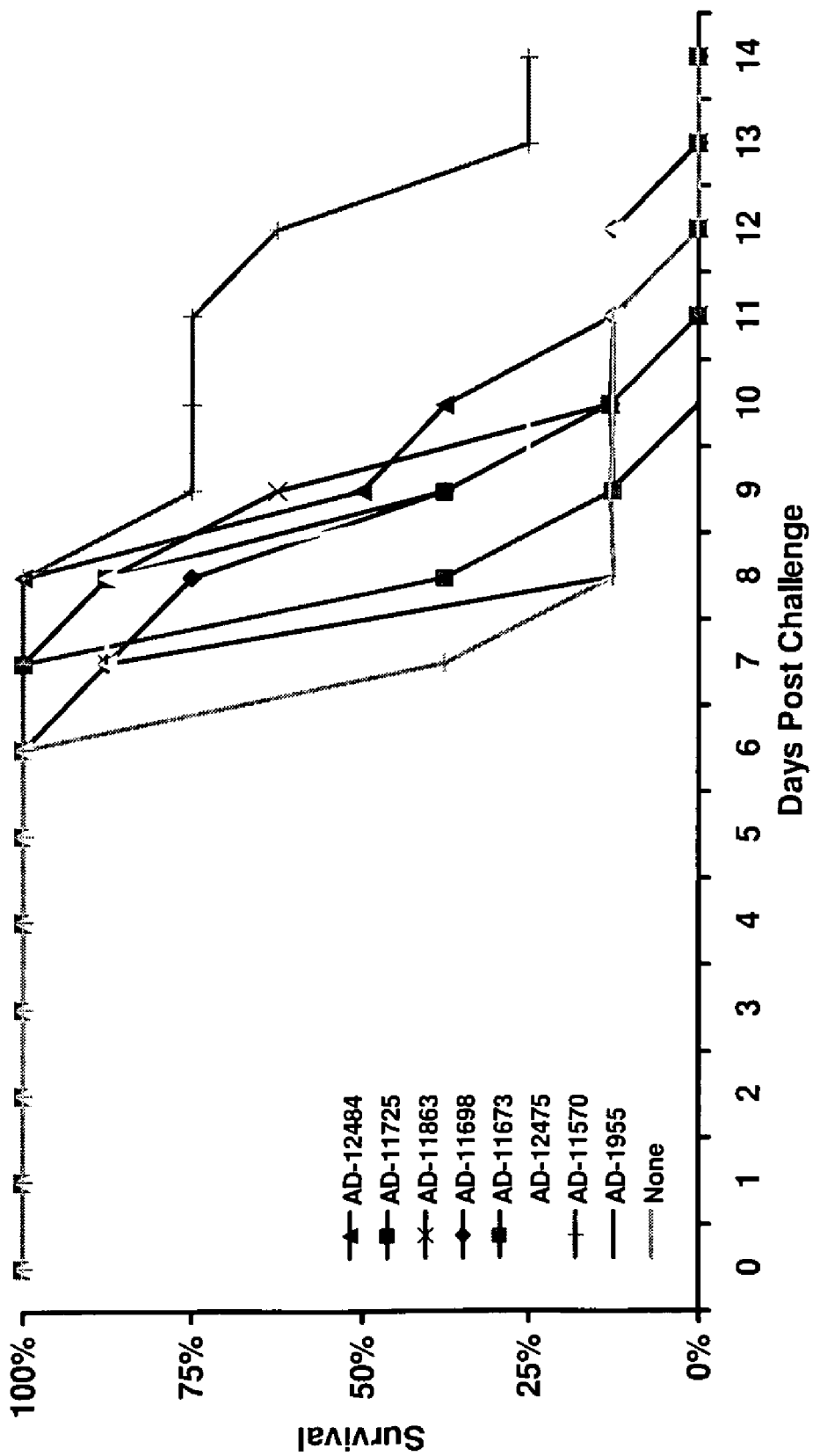
FIG. 7 is a graph showing the efficacy of siRNAs against different Ebola genes formulated with DODMA in a guinea pig model of Ebola.

Guinea pig study #11: Efficacy of siRNAs formulated with DODMA and targeting different Ebola genes in a guinea pig model of Ebola. See FIG. 7

Figure 8:
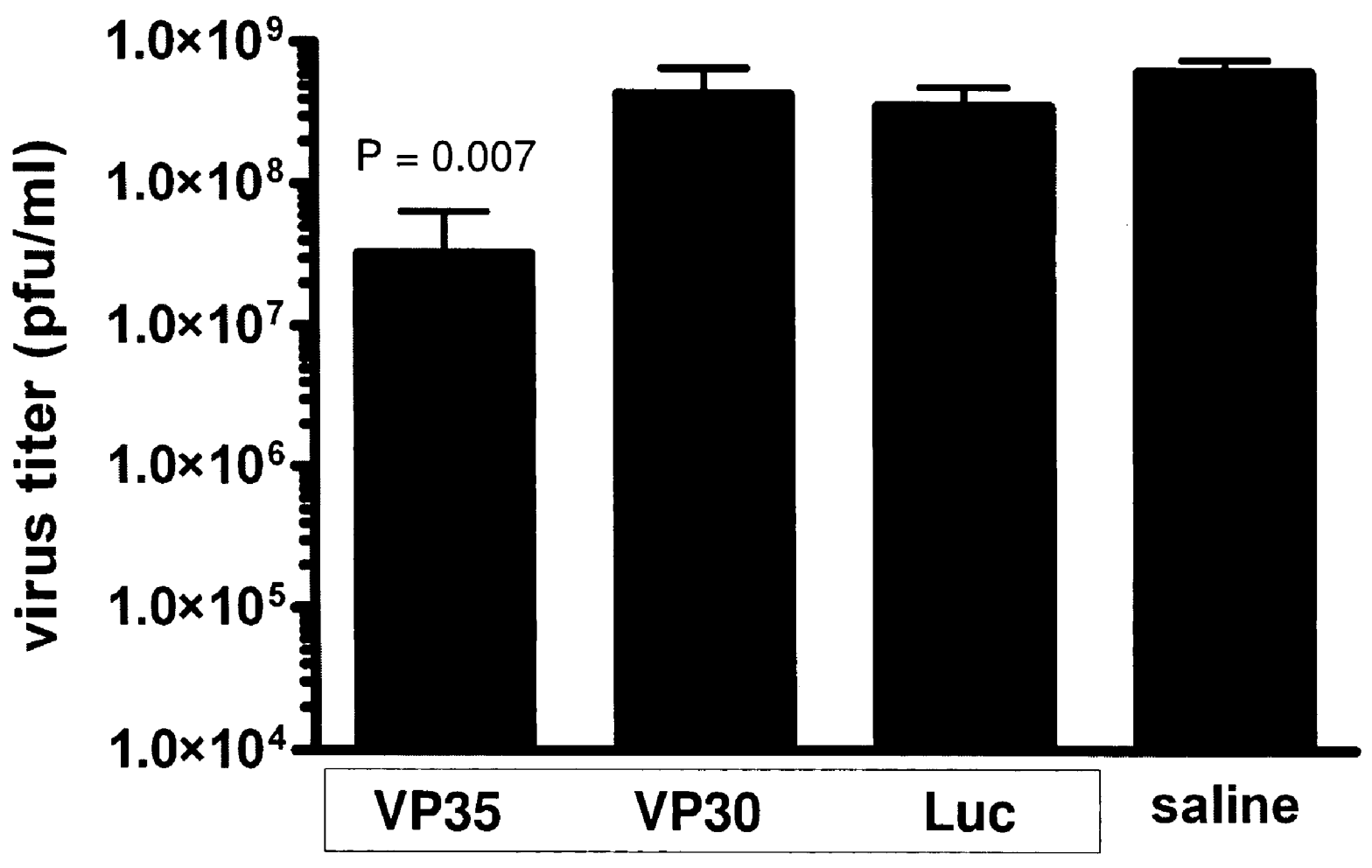

A 95% decrease in viral titers was also observed following administration of LNP01 formulated VP35 siRNA to BALB/c mice (n=5 per group) (FIG. 8). Mice were dosed systemically with LNP01 formulated siRNA at 5 mg/kg i.v. at day 0, then 3 mg/kg i.p. at day 3. Two hours post-siRNA injection at day 0, mice were injected with 1,000 pfu Ebola-Zaire virus and monitored for survival. On day 6 post-infection, the mice were sacrificed and their blood viral titers were determined by plaque assay.

Table 3 shows the results of cell-based and plaque assays.
Table 4 shows the results of plaque assays for control siRNAs.
Table 5. shows the sequences of modified duplexes, and Table 6 shows the effect of the modified duplexes on plaque assay activity and $IC_{50}$ values in the plasmid-based system.
Table 7 shows the effect of siRNAs on cytokine levels (IFN-alpha and TNF-alpha).
Table 8 shows the siRNA silencing in the plasmid system and calculated $IC_{50}$ values.
Table 9 shows that nonhuman primates administered siRNAs targeting Ebola did not demonstrate a decrease in lymphocyte or platelet count.

TABLE 2

| position in target | Target | double overhang design sense strand | | | antisense strand | | | duplex name |
|---|---|---|---|---|---|---|---|---|
| | | name | Seq ID | sequence (5'-3') | name | Seq ID | sequence (5'-3') | |
| 3-21 | VP35 | A18480 | 1 | GAUGAAGAUUAAAACCUUCTsT | A18481 | 2 | GAAGGUUUUAAUCUUCAUCTsT | AD-11542 |
| 4-22 | VP35 | A18482 | 3 | AUGAAGAUUAAAACCUUCATsT | A18483 | 4 | UGAAGGUUUUAAUCUUCAUTsT | AD-11543 |
| 5-23 | VP35 | A18484 | 5 | UGAAGAUUAAAACCUUCAUTsT | A18485 | 6 | AUGAAGGUUUUAAUCUUCATsT | AD-11544 |
| 6-24 | VP35 | A18486 | 7 | GAAGAUUAAAACCUUCAUCTsT | A18487 | 8 | GAUGAAGGUUUUAAUCUUCTsT | AD-11545 |
| 1354-1372 | VP35 | A18488 | 9 | UGAUGAAGAUUAAGAAAAATsT | A18489 | 10 | UUUUUCUUAAUCUUCAUCATsT | AD-11546 |
| 7-25 | VP35 | A18490 | 11 | AAGAUUAAAACCUUCAUCATsT | A18491 | 12 | UGAUGAAGGUUUUAAUCUUTsT | AD-11547 |
| 8-26 | VP35 | A18492 | 13 | AGAUUAAAACCUUCAUCAUTsT | A18493 | 14 | AUGAUGAAGGUUUUAAUCUTsT | AD-11548 |
| 9-27 | VP35 | A18494 | 15 | GAUUAAAACCUUCAUCAUCTsT | A18495 | 16 | GAUGAUGAAGGUUUUAAUCTsT | AD-11549 |
| 10-28 | VP35 | A18496 | 17 | AUUAAAACCUUCAUCAUCCTsT | A18497 | 18 | GGAUGAUGAAGGUUUUAAUTsT | AD-11550 |
| 11-29 | VP35 | A18498 | 19 | UUAAAACCUUCAUCAUCCUTsT | A18499 | 20 | AGGAUGAUGAAGGUUUUAATsT | AD-11551 |
| 12-30 | VP35 | A18500 | 21 | UAAAACCUUCAUCAUCCUUTsT | A18501 | 22 | AAGGAUGAUGAAGGUUUUATsT | AD-11552 |

TABLE 2-continued

| position in target | Target | double overhang design sense strand | | | antisense strand | | | duplex name |
|---|---|---|---|---|---|---|---|---|
| | | name | Seq ID | sequence (5'-3') | name | Seq ID | sequence (5'-3') | |
| 1-19 | VP30 | A18502 | 23 | GAUGAAGAUUAAGAAAAAGTsT | A18503 | 24 | CUUUUUCUUAAUCUUCAUCTsT | AD-11553 |
| 3-21 | VP35 | A18504 | 151 | GAuGAAGAuuAAAAccuucTsT | A18505 | 152 | GAAGGUUUuAAUCUUcAUCTsT | AD-11554 |
| 4-22 | VP35 | A18506 | 153 | AuGAAGAuuAAAAccuucATsT | A18507 | 154 | UGAAGGUUUuAAUCUUcAUTsT | AD-11555 |
| 5-23 | VP35 | A18508 | 155 | uGAAGAuuAAAAccuucAuTsT | A18509 | 156 | AUGAAGGUUUuAAUCUUCATsT | AD-11556 |
| 6-24 | VP35 | A18510 | 157 | GAAGAuuAAAAccuucAucTsT | A18511 | 158 | GAUGAAGGUUUuAAUCUUCTsT | AD-11557 |
| 1354-1372 | VP35 | A18512 | 159 | uGAuGAAGAuuAAGAAAAATsT | A18513 | 160 | UUUUUCUuAAUCUUcAUCATsT | AD-11558 |
| 7-25 | VP35 | A18514 | 161 | AAGAuuAAAAccuucAucATsT | A18515 | 162 | UGAUGAAGGUUUuAAUCUUTsT | AD-11559 |
| 8-26 | VP35 | A18516 | 163 | AGAuuAAAAccuucAucAuTsT | A18517 | 164 | AUGAUGAAGGUUUuAAUCUTsT | AD-11560 |
| 9-27 | VP35 | A18518 | 165 | GAuuAAAAccuucAucAucTsT | A18519 | 166 | GAUGAUGAAGGUUUuAAUCTsT | AD-11561 |
| 10-28 | VP35 | A18520 | 167 | AuuAAAAccuucAucAuccTsT | A18521 | 168 | GGAUGAUGAAGGUUUuAAUTsT | AD-11562 |
| 11-29 | VP35 | A18522 | 169 | uuAAAAccuucAucAuccuTsT | A18523 | 170 | AGGAUGAUGAAGGUUUuAATsT | AD-11563 |
| 12-30 | VP35 | A18524 | 171 | uAAAAccuucAucAuccuuTsT | A18525 | 172 | AAGGAUGAUGAAGGUUUuATsT | AD-11564 |
| 1-19 | VP30 | A18526 | 173 | GAuGAAGAuuAAGAAAAAGTsT | A18527 | 174 | CUUUUUCUuAAUCUUcAUCTsT | AD-11565 |
| 3-21 | VP35 | A18528 | 1019 | GAuGAAGAuuAAAAccuucTsT | A18529 | 1020 | GAAGGuuuUAAUCuUcAUCTsT | AD-11566 |
| 4-22 | VP35 | A18530 | 1021 | AuGAAGAuuAAAAccuucATsT | A18531 | 1022 | uGAAGGuuuUAAUCuUcAUTsT | AD-11567 |
| 5-23 | VP35 | A18532 | 1023 | uGAAGAuuAAAAccuucAuTsT | A18533 | 1024 | AuGAAGGuuuuAAUCuUcATsT | AD-11568 |
| 6-24 | VP35 | A18534 | 1025 | GAAGAuuAAAAccuucAucTsT | A18535 | 1026 | GAuGAAGGuuuuAAUCuUCTsT | AD-11569 |
| 1354-1372 | VP35 | A18536 | 1027 | uGAuGAAGAuuAAGAAAAATsT | A18537 | 1028 | uuuuUCuuAAUCuUcAUCATsT | AD-11570 |
| 7-25 | VP35 | A18538 | 1029 | AAGAuuAAAAccuucAucATsT | A18539 | 1030 | uGAuGAAGGuuuuAAUCuUTsT | AD-11571 |
| 8-26 | VP35 | A18540 | 1031 | AGAuuAAAAccuucAucAuTsT | A18541 | 1032 | AuGAuGAAGGuuuuAAUCUTsT | AD-11572 |
| 9-27 | VP35 | A18542 | 1033 | GAuuAAAAccuucAucAucTsT | A18543 | 1034 | GAuGAuGAAGGuuuuAAUCTsT | AD-11573 |
| 10-28 | VP35 | A18544 | 1035 | AuuAAAAccuucAucAuccTsT | A18545 | 1036 | GCAuGAuGAAGGuuuuAAUTsT | AD-11574 |
| 11-29 | VP35 | A18546 | 1037 | uuAAAAccuucAucAuccuTsT | A18547 | 1038 | AGGAuGAuGAAGGuuuuAATsT | AD-11575 |
| 12-30 | VP35 | A18548 | 1039 | uAAAAccuucAucAuccuuTsT | A18549 | 1040 | AAGGAuGAuGAAGGuuuuATsT | AD-11576 |
| 1-19 | VP30 | A18550 | 1041 | GAuGAAGAuuAAGAAAAAGTsT | A18551 | 1042 | CuuuuUCuuAAUCuUcAUCTsT | AD-11577 |
| 996-1014 | NP | A18552 | 25 | UGGACACAUGAUGGUGAUCTsT | A18553 | 26 | GAUCACCAUCAUGUGUCCATsT | AD-11578 |
| 1467-1485 | NP | A18554 | 27 | AAGCAACUCCAACAAUAUGTsT | A18555 | 28 | CAUAUUGUUGGAGUUGCUUTsT | AD-11579 |
| 11-29 | VP35 | A18556 | 29 | AAAACCUUCAUCAUCCUUUTsT | A18557 | 30 | AAAGGAUGAUGAAGGUUUUTsT | AD-11580 |
| 1357-1375 | VP35 | A18558 | 31 | UUGAUGAAGAUUAAGAAAATsT | A18559 | 32 | UUUUCUUAAUCUUCAUCAATsT | AD-11581 |
| 1-19 | VP40 | A18560 | 33 | GAUGAAGAUUAAGAAAAAGTsT | A18561 | 34 | CUUUUUCUUAAUCUUCAUCTsT | AD-11582 |
| 647-665 | VP40 | A18562 | 35 | CCCUGCUGCAACAUGGACATsT | A18563 | 36 | UGUCCAUGUUGCAGCAGGGTsT | AD-11583 |
| 2-20 | VP30 | A18564 | 37 | AUGAAGAUUAAGAAAAAGUTsT | A18565 | 38 | ACUUUUUCUUAAUCUUCAUTsT | AD-11584 |
| 1-19 | L | A18566 | 39 | AAGAUUAAGAAAAAGUCCATsT | A18567 | 40 | UGGACUUUUUCUUAAUCUUTsT | AD-11585 |
| 5-23 | NP | A18568 | 41 | AAGAUUAAUAAUUUUCCUCTsT | A18569 | 42 | GAGGAAAAUUAUUAAUCUUTsT | AD-11586 |
| 823-841 | NP | A18570 | 43 | AUGCCGGAAGAGGAGACAATsT | A18571 | 44 | UUGUCUCCUCUUCCGGCAUTsT | AD-11587 |
| 824-842 | NP | A18572 | 45 | UGCCGGAAGAGGAGACAACTsT | A18573 | 46 | GUUGUCUCCUCUUCCGGCATsT | AD-11588 |

TABLE 2-continued

| position in target | Target | double overhang design sense strand | | | antisense strand | | | duplex name |
|---|---|---|---|---|---|---|---|---|
| | | name | Seq ID | sequence (5'-3') | name | Seq ID | sequence (5'-3') | |
| 987-1005 | NP | A18574 | 47 | GCAAUCAGUAGGACACAUGTsT | A18575 | 48 | CAUGUGUCCUACUGAUUGCTsT | AD-11589 |
| 988-1006 | NP | A18576 | 49 | CAAUCAGUAGGACACAUGATsT | A18577 | 50 | UCAUGUGUCCUACUGAUUGTsT | AD-11590 |
| 989-1007 | NP | A18578 | 51 | AAUCAGUAGGACACAUGAUTsT | A18579 | 52 | AUCAUGUGUCCUACUGAUUTsT | AD-11591 |
| 990-1008 | NP | A18580 | 53 | AUCAGUAGGACACAUGAUGTsT | A18581 | 54 | CAUCAUGUGUCCUACUGAUTsT | AD-11592 |
| 991-1009 | NP | A18582 | 55 | UCAGUAGGACACAUGAUGGTsT | A18583 | 56 | CCAUCAUGUGUCCUACUGATsT | AD-11593 |
| 992-1010 | NP | A18584 | 57 | CAGUAGGACACAUGAUGGUTsT | A18585 | 58 | ACCAUCAUGUGUCCUACUGTsT | AD-11594 |
| 993-1011 | NP | A18586 | 59 | AGUAGGACACAUGAUGGUGTsT | A18587 | 60 | CACCAUCAUGUGUCCUACUTsT | AD-11595 |
| 994-1012 | NP | A18588 | 61 | GUAGGACACAUGAUGGUGATsT | A18589 | 62 | UCACCAUCAUGUGUCCUACTsT | AD-11596 |
| 995-1013 | NP | A18590 | 63 | UAGGACACAUGAUGGUGAUTsT | A18591 | 64 | AUCACCAUCAUGUGUCCUATsT | AD-11597 |
| 1005-1023 | NP | A18592 | 65 | GAUGGUGAUUUUCCGUUUGTsT | A18593 | 66 | CAAACGGAAAAUCACCAUCTsT | AD-11598 |
| 1006-1024 | NP | A18594 | 67 | AUGGUGAUUUUCCGUUUGATsT | A18595 | 68 | UCAAACGGAAAAUCACCAUTsT | AD-11599 |
| 1007-1025 | NP | A18596 | 69 | UGGUGAUUUUCCGUUUGAUTsT | A18597 | 70 | AUCAAACGGAAAAUCACCATsT | AD-11600 |
| 1008-1026 | NP | A18598 | 71 | GGUGAUUUUCCGUUUGAUGTsT | A18599 | 72 | CAUCAAACGGAAAAUCACCTsT | AD-11601 |
| 1462-1480 | NP | A18600 | 73 | GCUGAGAAGCAACUCCAACTsT | A18601 | 74 | GUUGGAGUUGCUUCUCAGCTsT | AD-11602 |
| 1463-1481 | NP | A18602 | 75 | CUGAGAAGCAACUCCAACATsT | A18603 | 76 | UGUUGGAGUUGCUUCUCAGTsT | AD-11603 |
| 1464-1482 | NP | A18604 | 77 | UGAGAAGCAACUCCAACAATsT | A18605 | 78 | UUGUUGGAGUUGCUUCUCATsT | AD-11604 |
| 1465-1483 | NP | A18606 | 79 | GAGAAGCAACUCCAACAAUTsT | A18607 | 80 | AUUGUUGGAGUUGCUUCUCTsT | AD-11605 |
| 1466-1484 | NP | A18608 | 81 | AGAAGCAACUCCAACAAUATsT | A18609 | 82 | UAUUGUUGGAGUUGCUUCUTsT | AD-11606 |
| 1353-1371 | VP35 | A18610 | 83 | AAAAGUGAUGAAGAUUAAGTsT | A18611 | 84 | CUUAAUCUUCAUCACUUUUTsT | AD-11607 |
| 1354-1372 | VP35 | A18612 | 85 | AAAGUGAUGAAGAUUAAGATsT | A18613 | 86 | UCUUAAUCUUCAUCACUUUTsT | AD-11608 |
| 1355-1373 | VP35 | A18614 | 87 | AAGUGAUGAAGAUUAAGAATsT | A18615 | 88 | UUCUUAAUCUUCAUCACUUTsT | AD-11609 |
| 1356-1374 | VP35 | A18616 | 89 | AGUGAUGAAGAUUAAGAAATsT | A18617 | 90 | UUUCUUAAUUUCAUCACUTsT | AD-11610 |
| 645-663 | VP40 | A18618 | 91 | CUGCCUGCUGCAACAUGGATsT | A18619 | 92 | UCCAUGUUGCAGCAGGCAGTsT | AD-11611 |
| 646-664 | VP40 | A18620 | 93 | UGCCUGCUGCAACAUGGACTsT | A18621 | 94 | GUCCAUGUtJGCAGCAGGCATsT | AD-11612 |
| 451-469 | GP | A18622 | 95 | GGCUGAAAACUGCUACAAUTsT | A18623 | 96 | AUUGUAGCAGUUUUCAGCCTsT | AD-11613 |
| 452-470 | GP | A18624 | 97 | GCUGAAAACUGCUACAAUCTsT | A18625 | 98 | GAUUGUAGCAGUUUUCAGCTsT | AD-11614 |
| 453-471 | GP | A18626 | 99 | CUGAAAACUGCUACAAUCUTsT | A18627 | 100 | AGAUUGUAGCAGUUUUCAGTsT | AD-11615 |
| 454-472 | GP | A18628 | 101 | UGAAAACUGCUACAAUCUUTsT | A18629 | 102 | AAGAUUGUAGCAGUUUUCATsT | AD-11616 |
| 455-473 | GP | A18630 | 103 | GAAAACUGCUACAAUCUUGTsT | A18631 | 104 | CAAGAUUGUAGCAGUUUUCTsT | AD-11617 |
| 456-474 | GP | A18632 | 105 | AAAACUGCUACAAUCUUGATsT | A18633 | 106 | UCAAGAUUGUAGCAGUUUUTsT | AD-11618 |
| 457-475 | GP | A18634 | 107 | AAACUGCUACAAUCUUGAATsT | A18635 | 108 | UUCAAGAUUGUAGCAGUUUTsT | AD-11619 |
| 458-476 | GP | A18636 | 109 | AACUGCUACAAUCUUGAAATsT | A18637 | 110 | UUUCAAGAUUGUAGCAGUUTsT | AD-11620 |
| 459-477 | GP | A18638 | 111 | ACUGCUACAAUCUUGAAAUTsT | A18639 | 112 | AUUUCAAGAUUGUAGCAGUTsT | AD-11621 |
| 599-617 | VP30 | A18640 | 113 | AGCAAAUCCAACGGCUGAUTsT | A18641 | 114 | AUCAGCCGUUGGAUUUGCUTsT | AD-11622 |
| 600-618 | VP30 | A18642 | 115 | GCAAAUCCAACGGCUGAUGTsT | A18643 | 116 | CAUCAGCCGUUGGAUUUGCTsT | AD-11623 |
| 601-619 | VP30 | A18644 | 117 | CAAAUCCAACGGCUGAUGATsT | A18645 | 118 | UCAUCAGCCGUUGGAUUUGTsT | AD-11624 |
| 135-153 | L | A18646 | 119 | UUGGACCAAUGUGACCUAGTsT | A18647 | 120 | CUAGGUCACAUUGGUCCAATsT | AD-11625 |

TABLE 2-continued

| position in target | Target | double overhang design sense strand | | | antisense strand | | | duplex name |
|---|---|---|---|---|---|---|---|---|
| | | name | Seq ID | sequence (5'-3') | name | Seq ID | sequence (5'-3') | |
| 136-154 | L | A18648 | 121 | UGGACCAAUGUGACCUAGUTsT | A18649 | 122 | ACUAGGUCACAUUGGUCCATsT | AD-11626 |
| 2100-2118 | L | A18650 | 123 | AUGCAUGUCAGUGAUUAUUTsT | A18651 | 124 | AAUAAUCACUGACAUGCAUTsT | AD-11627 |
| 2101-2119 | L | A18652 | 125 | UGCAUGUCAGUGAUUAUUATsT | A18653 | 126 | UAAUAAUCACUGACAUGCATsT | AD-11628 |
| 2102-2120 | L | A18654 | 127 | GCAUGUCAGUGAUUAUUAUTsT | A18655 | 128 | AUAAUAAUCACUGACAUGCTsT | AD-11629 |
| 2103-2121 | L | A18656 | 129 | CAUGUCAGUGAUUAUUAUATsT | A18657 | 130 | UAUAAUAAUCACUGACAUGTsT | AD-11630 |
| 2104-2122 | L | A18658 | 131 | AUGUCAGUGAUUAUUAUAATsT | A18659 | 132 | UUAUAAUAAUCACUGACAUTsT | AD-11631 |
| 2114-2132 | L | A18660 | 133 | UUAUUAUAAUCCACCACAUTsT | A18661 | 134 | AUGUGGUGGAUUAUAAUAATsT | AD-11632 |
| 2115-2133 | L | A18662 | 135 | UAUUAUAAUCCACCACAUATsT | A18663 | 136 | UAUGUGGUGGAUUAUAAUATsT | AD-11633 |
| 2116-2134 | L | A18664 | 137 | AUUAUAAUCCACCACAUAATsT | A18665 | 138 | UUAUGUGGUGGAUUAUAAUTsT | AD-11634 |
| 2412-2430 | L | A18666 | 139 | AAAGUUACAAGUGCCUGUGTsT | A18667 | 140 | CACAGGCACUUGUAACUUUTsT | AD-11635 |
| 2413-2431 | L | A18668 | 141 | AAGUUACAAGUGCCUGUGGTsT | A18669 | 142 | CCACAGGCACUUGUAACUUTsT | AD-11636 |
| 2466-2484 | L | A18670 | 143 | UCAGGUUUUAUCUAUUUUGTsT | A18671 | 144 | CAAAAUAGAUAAAACCUGATsT | AD-11637 |
| 2467-2485 | L | A18672 | 145 | CAGGUUUUAUCUAUUUUGGTsT | A18673 | 146 | CCAAAAUAGAUAAAACCUGTsT | AD-11638 |
| 2556-2574 | L | A18674 | 147 | UCUGAUGCAAUUUUUGAUGTsT | A18675 | 148 | CAUCAAAAAUUGCAUCAGATsT | AD-11639 |
| 2557-2557 | L | A18676 | 149 | CUGAUGCAAUUUUUGAUGATsT | A18677 | 150 | UCAUCAAAAAUUGCAUCAGTsT | AD-11640 |
| 1825-1843 | NP | A18678 | 1085 | AGUUACUCGGAAAACGGCAUTsT | A18679 | 1086 | UGCCGUUUUCCGAGuAACUTsT | AD-11641 |
| 1588-1606 | NP | A18680 | 1087 | AAcGcuAuGGuAAcucuAATsT | A18681 | 1088 | UuAGAGUuACcAuAGCGUUUTsT | AD-11642 |
| 1827-1845 | NP | A18682 | 1089 | uuAcuCGGAAAACGGCAuGTsT | A18683 | 1090 | cAUGCCGUUUUCCGAGuAATsT | AD-11643 |
| 1583-1601 | NP | A18684 | 1091 | AAAcAAAcGcuAuGGuAAcTsT | A18685 | 1092 | GUuACcAuAGCGUUUGUUUTsT | AD-11644 |
| 1488-1506 | NP | A18686 | 1093 | AGAGucucGcGAAcuuGAcTsT | A18687 | 1094 | GUcAAGUUCGCGAGACUCUTsT | AD-11645 |
| 1489-1507 | NP | A18688 | 1095 | GAGucucGcGAAcuuGAccTsT | A18689 | 1096 | GGUcAAGUUCGCGAGACUCTsT | AD-11646 |
| 1585-1603 | NP | A18690 | 1097 | AcAAAcGcuAuGGuAAcucTsT | A18691 | 1098 | GAGUuACcAuAGCGUUUGUTsT | AD-11647 |
| 1586-1604 | NP | A18692 | 1099 | cAAAcGcuAuGGuAAcucuTsT | A18693 | 1100 | AGAGUuACcAuAGCGUUUGTsT | AD-16648 |
| 2231-2249 | NP | A18694 | 1101 | cAccGGcucccGuAuAcAGTsT | A18695 | 1102 | CUGuAuACGGGAGCCGGUGTsT | AD-11649 |
| 2873-2891 | NP | A18696 | 1103 | cuAAcuAGcGAuuuAucuATsT | A18697 | 1104 | uAGAuAAAUCGCuAGUuAGTsT | AD-11650 |
| 1172-1190 | VP35 | A18698 | 1105 | GCUGAACUAUAGGGUACGUTsT | A18699 | 1106 | ACGuACCCuAuAGUUcAGCTsT | AD-11651 |
| 1176-1194 | VP35 | A18700 | 1107 | AAcuAuAGGGuAcGuuAcATsT | A18701 | 1108 | UGuAACGuACCCuAuAGUUTsT | AD-11652 |
| 1174-1192 | VP35 | A18702 | 175 | uGAAcuAuAGGGuAcGuuATsT | A18703 | 176 | uAACGuACCCuAuAGUUcATsT | AD-11653 |
| 1178-1196 | VP35 | A18706 | 177 | cuAuAGGGuAcGuuAcAuuTsT | A18707 | 178 | AAUGuAACGuACCCuAuAGTsT | AD-11655 |
| 251-269 | VP35 | A18704 | 179 | GGAuuAuGcuAcGcAucccTsT | A18705 | 180 | GGGAUGCGuAGcAuAAUCCTsT | AD-11654 |
| 416-434 | VP35 | A18708 | 181 | uuAGAAcAAcGcAuuAcGATsT | A18709 | 182 | UCGuAAUGCGUUGUUCuAATsT | AD-16656 |
| 421-439 | VP35 | A18710 | 183 | AcAAcGcAuuAcGAGucuuTsT | A18711 | 184 | AAGACUCGuAAUGCGUUGUTsT | AD-11657 |
| 1057-1075 | VP35 | A18712 | 185 | uGAucGAGGuuGGGuAuGuTsT | A18713 | 186 | AcAuACCCAACCUCGAUcATsT | AD-11658 |
| 167-185 | GP | A18714 | 187 | ccucGuGAucGAuucAAGATsT | A18715 | 188 | UCUUGAAUCGAuCACGAGGTsT | AD-11659 |
| 163-181 | GP | A18716 | 189 | GuuAccucGuGAucGAuucTsT | A18717 | 190 | GAAUCGAUcACGAGGuAACTsT | AD-11660 |
| 658-676 | GP | A18720 | 191 | AAcGAcuuucGcuGAAGGuTsT | A18721 | 192 | ACCUUcAGCGAAAGUCGUUTsT | AD-11662 |

TABLE 2-continued

| position | | double overhang design sense strand | | | antisense strand | | | |
|---|---|---|---|---|---|---|---|---|
| in target | Target | name | Seq ID | sequence (5'-3') | name | Seq ID | sequence (5'-3') | duplex name |
| 755-773 | GP | A18722 | 193 | AcGGAGGAcccGucuAGuGTsT | A18723 | 194 | cACuAGACGGGUCCUCCGUTsT | AD-11663 |
| 966-984 | GP | A18724 | 195 | AGGucAAccccGAAAuuGATsT | A18725 | 196 | UcAAUUUCGGGGUUGACCUTsT | AD-11664 |
| 978-996 | GP | A18726 | 197 | AAAuuGAuAcAAcAAucGGTsT | A18727 | 198 | CCGAUUGUUGuAUcAAUUUTsT | AD-11665 |
| 985-1003 | GP | A18728 | 199 | uAcAAcAAucGGGGAGuGGTsT | A18729 | 200 | CcACUCCCCGAUUGUUGuATsT | AD-11666 |
| 1101-1119 | GP | A18730 | 201 | AGAGuccGGcGcGAAcuucTsT | A18731 | 202 | GAAGuUCGCGCCGGACUCUTsT | AD-11667 |
| 1730-1748 | GP | A18718 | 203 | uGGAuAccAuAuuucGGGcTsT | A18719 | 204 | GCCCGAAAuAUGGuAUCcATsT | AD-11661 |
| 1820-1838 | GP | A18732 | 205 | cuGGccAAcGAGAcGAcucTsT | A18733 | 206 | GAGUCGUCUCGUUGGCcAGTsT | AD-11668 |
| 1298-1316 | VP30 | A18734 | 207 | uAucGcucGuAAuAuAAccTsT | A18735 | 208 | GGUuAuAUuACGAGCGAuATsT | AD-11669 |
| 295-313 | VP30 | A18736 | 209 | uucGAGcAcGAucAucAucTsT | A18737 | 210 | GAuGAuGAUCGuGCUCGAATsT | AD-11670 |
| 590-608 | VP30 | A18738 | 211 | cucGcGcuuAGcAAAuccATsT | A18739 | 212 | UGGAUUUGCuAAGCGCGAGTsT | AD-11671 |
| 519-537 | VP30 | A18740 | 213 | uuAcuccuAcuAAucGcccTsT | A18741 | 214 | GGGCGAUuAGuAGGAGuAATsT | AD-11672 |
| 126-144 | VP30 | A18742 | 215 | cuGcGAAccGGuAGAGuuuTsT | A18743 | 216 | AAACUCuACCGGUUCGcAGTsT | AD-11673 |
| 133-151 | VP30 | A18744 | 217 | CcGGuAGAGuuuAGuuGcATsT | A18745 | 218 | UGcAACuAAACUCuACCGGTsT | AD-11674 |
| 292-310 | VP30 | A18746 | 219 | AuGuucGAGcAcGAucAucTsT | A18747 | 220 | GAUGAUCGUGCUCGAAcAUTsT | AD-11675 |
| 321-339 | VP30 | A18748 | 221 | AAuuAucGAGGuGAGuAccTsT | A18749 | 222 | GGuACUcACCUCGAuAAUUTsT | AD-11676 |
| 910-928 | VP30 | A18750 | 223 | GGGAccGAcAAucccuAAuTsT | A18751 | 224 | AUuAGGGAUUGUCGGUCCCTsT | AD-11677 |
| 1295-1313 | VP30 | A18752 | 225 | ucGuAucGcucGuAAuAuATsT | A18753 | 226 | uAuAUuACGAGCGAuACGATsT | AD-11678 |
| 331-349 | VP30 | A18754 | 227 | GuGAGuAccGucAAucAAGTsT | A18755 | 228 | CUUGAUUGACGGuACUcACTsT | AD-11679 |
| 123-141 | VP30 | A18756 | 229 | GAucuGcGAAccGGuAGAGTsT | A18757 | 230 | CUCuACCGGUUCGcAGAUCTsT | AD-11680 |
| 124-142 | VP30 | A18758 | 231 | AucuGcGAAccGGuAGAGuTsT | A18759 | 232 | ACUCuACCGGUUCGcAGAUTsT | AD-11681 |
| 1293-1311 | VP30 | A18760 | 233 | ucucGuAucGcucGuAAuATsT | A18761 | 234 | uAUuACGAGCGAuACGAGATsT | AD-11682 |
| 145-163 | VP30 | A18762 | 235 | AGuuGcAAccuAAcAcAcATsT | A18763 | 236 | UGUGUGUuAGGUUGcAACUTsT | AD-11683 |
| 293-311 | VP30 | A18764 | 237 | uGuucGAGcAcGAucAucATsT | A18765 | 238 | UGAUGAUCGUGCUCGAAcATsT | AD-11684 |
| 358-376 | VP30 | A18766 | 239 | cAcAAGuGcGcGuuccuAcTsT | A18767 | 240 | GuAGGAACGCGcACUUGUGTsT | AD-11685 |
| 359-377 | VP30 | A18768 | 241 | AcAAGuGcGcGuuccuAcuTsT | A18769 | 242 | AGuAGGAACGCGcACUUGUTsT | AD-11686 |
| 518-536 | VP30 | A18770 | 243 | AuuAcuccuAcuAAucGccTsT | A18771 | 244 | GGCGAUuAGuAGGAGuAAUTsT | AD-11687 |
| 520-538 | VP30 | A18772 | 245 | uAcuccuAcuAAucGcccGTsT | A18773 | 246 | CGGGCGAUuAGuAGGAGuATsT | AD-11688 |
| 524-542 | VP30 | A18774 | 247 | ccuAcuAAucGcccGuAAGTsT | A18775 | 248 | CUuACGGGCGAUuAGuAGGTsT | AD-11689 |
| 525-543 | VP30 | A18776 | 249 | cuAcuAAucGcccGuAAGATsT | A18777 | 250 | UCUuACGGGCGAUuAGuAGTsT | AD-11690 |
| 584-602 | VP30 | A18778 | 251 | cAAGGAcucGcGcuuAGcATsT | A18779 | 252 | UGCuAAGCGCGAGUCCUUGTsT | AD-11691 |
| 469-487 | VP24 | A18784 | 253 | AGcuACGGGAcGAuAcAAuTsT | A18785 | 254 | AUUGuAUCGUCCCGuAGCUTsT | AD-11694 |
| 910-928 | VP24 | A18786 | 255 | GucGuuGAuucGAuccAAuTsT | A18787 | 256 | AUUGGAUCGAAUcAACGACTsT | AD-11695 |
| 467-485 | VP24 | A18788 | 257 | AAAGcuAcGGGAcGAuACATsT | A18789 | 258 | UGuAUCGUCCCGuAGCUUUTsT | AD-11696 |
| 862-880 | VP24 | A18792 | 259 | cAAcAuGcGAAcAcAAcGuTsT | A18793 | 260 | ACGUUGUGUUCGcAUGUUGTsT | AD-11698 |
| 466-484 | VP24 | A18796 | 261 | uAAAGcuAcGGGAcGAuAcTsT | A18797 | 262 | GuAUCGUCCCGuAGCUUuATsT | AD-11700 |
| 523-541 | VP24 | A18804 | 263 | uGucuuAAGcGAccucuGuTsT | A18805 | 264 | AcAGAGGUCGCUuAAGAcATsT | AD-11704 |
| 958-976 | VP24 | A18806 | 265 | ucuAcAuGucGuGAAcuAcTsT | A18807 | 266 | GuAGUUcACGAcAUGuAGATsT | AD-11705 |

TABLE 2-continued

| position in target | Target | sense strand name | Seq ID | sequence (5'-3') | antisense strand name | Seq ID | sequence (5'-3') | duplex name |
|---|---|---|---|---|---|---|---|---|
| 959-977 | VP24 | A18808 | 267 | cuAcAuGucGuGAAcuAcATsT | A18809 | 268 | UGuAGUUcACGACAUGuAGTsT | AD-11706 |
| 971-989 | VP24 | A18810 | 269 | AAcuAcAACGGAuuGuuGATsT | A18811 | 270 | UcAAcAAUCCGUUGuAGUUTsT | AD-11707 |
| 1071-1089 | VP24 | A18812 | 271 | ccGAcAAAucGGcAAuGAATsT | A18813 | 272 | UUcAUUGCCGAUUUGUCGGTsT | AD-11708 |
| 5886-5904 | L | A18816 | 273 | AGAucGAAAuuGuAcGAAGTsT | A18817 | 274 | CUUCGuAcAAUUUCGAUCUTsT | AD-11710 |
| 192-210 | L | A18818 | 275 | AAuccGcAAcuAcGcAAcuTsT | A18819 | 276 | AGUUGCGuAGUUGCGGAUUTsT | AD-11711 |
| 5395-5413 | L | A18820 | 277 | cAcGccAAuuAAcGucAucTsT | A18821 | 278 | GAUGACGUuAAUUGGCGUGTsT | AD-11712 |
| 193-211 | L | A18822 | 279 | AuccGcAAcuAcGcAAcuGTsT | A18823 | 280 | cAGUUGCGuAGUUGCGGAUTsT | AD-11713 |
| 219-237 | L | A18824 | 281 | ccGAAAcAuAucuAccGuuTsT | A18825 | 282 | AACGGuAGAuAUGUUUCGGTsT | AD-11714 |
| 2840-2858 | L | A18826 | 283 | uuucuAccGGAAucuAGGATsT | A18827 | 284 | UCCuAGAUUCCGGuAGAAATsT | AD-11715 |
| 4779-4797 | L | A18828 | 285 | AuuAAucGcGGAAcAuuGTsT | A18829 | 286 | cAAUUGUUCCGCGAUuAAUTsT | AD-11716 |
| 5275-5293 | L | A18830 | 287 | AuuucGAucGAucGAGAcATsT | A18831 | 288 | uGUCUCGAUCGAUCGAAAUTsT | AD-11717 |
| 5391-5409 | L | A18832 | 289 | GGGAcAcGccAAuuAAcGuTsT | A18833 | 290 | ACGUuAAUUGGCGUGUCCCTsT | AD-11718 |
| 191-209 | L | A18834 | 291 | uAAuccGcAAcuAcGcAAcTsT | A18835 | 292 | GUUGCGuAGUUGCGGAUuATsT | AD-11719 |
| 1614-1632 | L | A18836 | 293 | AGuAcuAAAcGuGuAccGGTsT | A18837 | 294 | CCGGuAcACGUUuAGuACUTsT | AD-11720 |
| 4588-4606 | L | A18838 | 295 | cAcAucGcucAuuGcGAAuTsT | A18839 | 296 | AUUCGcAAUGAGCGAUGUGTsT | AD-11721 |
| 4590-4608 | L | A18840 | 297 | cAucGcucAuuGcGAAuAcTsT | A18841 | 298 | GuAUUCGcAAUGAGCGAUGTsT | AD-11722 |
| 5884-5902 | L | A18842 | 299 | AcAGAucGAAAuuGuAcGATsT | A18843 | 300 | UCGuAcAAUUUCGAUCUGUTsT | AD-11723 |
| 161-179 | L | A18844 | 301 | AGcuuGcGGGuuAuAuucATsT | A18845 | 302 | UGAAuAuAACCCGcAAGCUTsT | AD-11724 |
| 778-796 | L | A18846 | 303 | cuGccGAcGucuuGAuAAuTsT | A18847 | 304 | AUuAUcAAGACGUCGGcAGTsT | AD-11725 |
| 5446-5464 | L | A18848 | 305 | AGuAcuuAcGGcAAuuGAGTsT | A18849 | 306 | CUcAAUUGCCGuAAGuACUTsT | AD-11726 |
| 6297-6315 | L | A18850 | 307 | AAcCucGucGAuucAAAAATsT | A18851 | 308 | uuuuuGAAUCGACGAGGuUTsT | AD-11727 |
| 5269-5287 | L | A18852 | 309 | AAcuAAAuuucGAucGAucTsT | A18853 | 310 | GAUCGAUCGAAAUUuAGUUTsT | AD-11728 |
| 1778-1796 | L | A18854 | 311 | GccuuAuccGAcucGcAAuTsT | A18855 | 312 | AUUGCGAGUCGGAuAAGGCTsT | AD-11729 |
| 1780-1798 | L | A18856 | 313 | cuuAuccGAcucGcAAuGuTsT | A18857 | 314 | AcAUUGCGAGUCGGAuAAGTsT | AD-11730 |
| 3163-3181 | L | A18858 | 315 | GucGuuuuGcGGccGAuAuTsT | A18859 | 316 | AuAUCGGCCGcAAAACGACTsT | AD-11731 |
| 3164-3182 | L | A18860 | 317 | ucGuuuuGcGGccGAuAucTsT | A18861 | 318 | GAuAUCGGCCGcAAAACGATsT | AD-11732 |
| 5273-5291 | L | A18862 | 319 | AAAuuucGAucGAucGAGATsT | A18863 | 320 | UCUCGAUCGAUCGAAAuUTsT | AD-11733 |
| 6295-6313 | L | A18864 | 321 | AuAAccucGucGAuucAAATsT | A18865 | 322 | UUUGAAUCGACGAGGuuAUTsT | AD-11734 |
| 1702-1720 | L | A18866 | 323 | UACUACCACAAUAUCGGAATsT | A18867 | 324 | UUCCGAuAUUGUGGuAGuATsT | AD-11735 |
| 1781-1799 | L | A18868 | 325 | uuAuccGAcucGcAAuGuuTsT | A18869 | 326 | AAcAUUGCGAGUCGGAuAATsT | AD-11736 |
| 5270-5288 | L | A18870 | 327 | AcuAAAuuucGAucGAucGTsT | A18871 | 328 | CGAUCGAUCGAAAUUuAGUTsT | AD-11737 |
| 5276-5294 | L | A18872 | 329 | uuucGAucGAucGAGAcAcTsT | A18873 | 330 | GuGUCUCGAUCGAUCGAAATsT | AD-11738 |
| 5394-5412 | L | A18874 | 331 | AcAcGccAAuuAAcGucAuTsT | A18875 | 332 | AUGACGUuAAUUGGCGUGUTsT | AD-11739 |
| 6242-6260 | L | A18876 | 333 | AAGuuAuAuccGccuuGGuTsT | A18877 | 334 | ACcAAGGCGGAuAuAACUUTsT | AD-11740 |
| 182-200 | L | A18878 | 335 | AuAcucccuuAAuccGcAATsT | A18879 | 336 | UUGCGGAUuAAGGGAGuAUTsT | AD-11741 |
| 194-212 | L | A18880 | 337 | uccGcAAcuAcGcAAcuGuTsT | A18881 | 338 | AcAGUUGCGuAGUUGCGGATsT | AD-11742 |

TABLE 2-continued

| position in target | Target | double overhang design sense strand | | | antisense strand | | | duplex name |
|---|---|---|---|---|---|---|---|---|
| | | name | Seq ID | sequence (5'-3') | name | Seq ID | sequence (5'-3') | |
| 575-593 | L | A18882 | 339 | ucGAGGAAAcuCuAGAucATsT | A18883 | 340 | UGAUCuAGAGUUUCCUCGATsT | AD-11743 |
| 1565-1583 | L | A18884 | 341 | uGcAGuAuucGAGccuAAuTsT | A18885 | 342 | AUuAGGCUCGAAuACUGcATsT | AD-11744 |
| 1566-1584 | L | A18886 | 343 | GcAGuAuucGAGccuAAuGTsT | A18887 | 344 | cAUuAGGCUCGAAuACUGCTsT | AD-11745 |
| 1567-1585 | L | A18888 | 345 | cAGuAuucGAGccuAAuGuTsT | A18889 | 346 | AcAUuAGGCUCGAAuACUGTsT | AD-11746 |
| 2779-2797 | L | A18890 | 347 | CAUUGGCACUAGCGGUACCTsT | A18891 | 348 | GGuACCGCuAGUGCcAAUGTsT | AD-11747 |
| 2838-2856 | L | A18892 | 349 | uGuuucuAccGGAAucuAGTsT | A18893 | 350 | CuAGAUUCCGGuAGAAAcATsT | AD-11748 |
| 2892-2910 | L | A18894 | 351 | AcuuAucuccGAAuGAuuGTsT | A18895 | 352 | cAAUcAUUCGGAGAuAAGUTsT | AD-11749 |
| 2981-2999 | L | A18896 | 353 | AAAuccuAGcGGAuuAAAuTsT | A18897 | 354 | AUUuAAUCCGCuAGGAUUUTsT | AD-11750 |
| 2982-3000 | L | A18898 | 355 | AAuccuAGcGGAuuAAAuGTsT | A18899 | 356 | cAUUuAAUCCGCuAGGAUUTsT | AD-11751 |
| 3038-3056 | L | A18900 | 357 | GAuuGuAcGcAGGAccAucTsT | A18901 | 358 | GAUGGuCCUGCGuAcAAUCTsT | AD-11752 |
| 3149-3167 | L | A18902 | 359 | AAcuccuGuuAuGAGucGuTsT | A18903 | 360 | ACGACUcAuAAcAGGAGUUTsT | AD-11753 |
| 3168-3186 | L | A18904 | 361 | uuuGcGGccGAuAucuuuuTsT | A18905 | 362 | AAAAGAuAUCGGCCGcAAATsT | AD-11754 |
| 3889-3907 | L | A18906 | 363 | GGuAcAAcGAucAAuAcAGTsT | A18907 | 364 | CUGuAUUGAUCGUUGuACCTsT | AD-11755 |
| 3922-3940 | L | A18908 | 365 | uGGccAAucGuAuGAGuAATsT | A18909 | 366 | UuACUcAuACGAUUGGCcATsT | AD-11756 |
| 4001-4019 | L | A18910 | 367 | GucuGcAcGcGAcAGcAAuTsT | A18911 | 368 | AUUGCUGUCGCGUGcAGACTsT | AD-11757 |
| 4584-4602 | L | A18912 | 369 | cuAccAcAucGcucAuuGcTsT | A18913 | 370 | GcAAUGAGCGAUGUGGuAGTsT | AD-11758 |
| 4593-4611 | L | A18914 | 371 | cGcucAuuGcGAAuAcuuATsT | A18915 | 372 | uAAGuAUUCGcAAUGAGCGTsT | AD-11759 |
| 4598-4616 | L | A18916 | 373 | AuuGcGAAuAcuuAAGccATsT | A18917 | 374 | UGGCUuAAGuAUUCGcAAUTsT | AD-11760 |
| 4601-4619 | L | A18918 | 375 | GcGAAuAcuuAAGccAAcATsT | A18919 | 376 | UGUuGGCUuAAGuAUUCGCTsT | AD-11761 |
| 4638-4656 | L | A18920 | 377 | AuGucAcGGuuAAuGAGuATsT | A18921 | 378 | uACUcAUuAACCGUGAcAUTsT | AD-11762 |
| 4778-4796 | L | A18922 | 379 | AAuuAAucGcGGAAcAAuuTsT | A18923 | 380 | AAUUGUUCCGcGAUuAAUUTsT | AD-11763 |
| 5274-5292 | L | A18924 | 381 | AAuuucGAucGAucGAGAcTsT | A18925 | 382 | GUCUCGAUCGAUCGAAAuTsT | AD-11764 |
| 5392-5410 | L | A18926 | 383 | GGAcAcGccAAuuAAcGucTsT | A18927 | 384 | GACGUuAAUUGGCGUGUCCTsT | AD-11765 |
| 5649-5667 | L | A18928 | 385 | AcGcuAGcuAcuGAGuccATsT | A18929 | 386 | UGGACUcAGuAGCuAGCGUTsT | AD-11766 |
| 5833-5851 | L | A18930 | 387 | cuAAGcAAGucGAGGuuAuTsT | A18931 | 388 | AuAACCUCGACUUGCUuAGTsT | AD-11767 |
| 6243-6261 | L | A18932 | 389 | AGuuAuAuccGccuuGCuuTsT | A18933 | 390 | AACcAAGGCGGAuAuAACUTsT | AD-11768 |
| 6290-6308 | L | A18934 | 391 | cAGGuAuAAccucGucGAuTsT | A18935 | 392 | AUCGACGAGGUuAuACCUGTsT | AD-11769 |
| 6291-6309 | L | A18936 | 393 | AGGuAuAAccucGucGAuuTsT | A18937 | 394 | AAUCGACGAGGUuAuACCUTsT | AD-11770 |
| 1816-1834 | NP | A18938 | 395 | AcuAcGAGGAuucGGcuGATsT | A18939 | 396 | UcAGCCGAAUCCUCGuAGUTsT | AD-11771 |
| 875-893 | NP | A18940 | 397 | ucuAcccAAAcuuGucGuuTsT | A18941 | 398 | AACGAcAAGUUUGGGuAGATsT | AD-11772 |
| 1817-1835 | NP | A18942 | 399 | cuAcGAGGAuucGGcuGAATsT | A18943 | 400 | UUcAGCCGAAUCCUCGuAGTsT | AD-11773 |
| 1812-1830 | NP | A18944 | 401 | ccuGAcuAcGAGGAuucGGTsT | A18945 | 402 | CCGAAUCCUCGuAGUcAGGTsT | AD-11774 |
| 1819-1837 | NP | A18946 | 403 | AcGAGGAuucGGcuGAAGGTsT | A18947 | 404 | CCUUcAGCCGAAUCCUCGUTsT | AD-11775 |
| 2140-2158 | NP | A18948 | 405 | AcGAGAGucucAcAucccuTsT | A18949 | 406 | AGGGAuGuGAGACUCUCGUTsT | AD-11776 |
| 730-748 | VP35 | A18950 | 407 | AAAuuucGGGcGAccuuAcTsT | A18951 | 408 | GuAAGGUCGCCCGAAAUUUTsT | AD-11777 |
| 735-753 | VP35 | A18952 | 409 | ucGGGcGAccuuAcAuuucTsT | A18953 | 410 | GAAAUGuAAGGUCGCCCGATsT | AD-11778 |
| 195-213 | VP35 | A18954 | 411 | uGAccGGcAAAAuAccGcuTsT | A18955 | 412 | AGCGGuAUUUUGCCGGUcATsT | AD-11779 |

TABLE 2-continued

| position | | double overhang design sense strand | | | antisense strand | | | |
|---|---|---|---|---|---|---|---|---|
| in target | Target | name | Seq ID | sequence (5'-3') | name | Seq ID | sequence (5'-3') | duplex name |
| 198-216 | VP35 | A18956 | 413 | ccGGcAAAAuACcGcUAAcTsT | A18957 | 414 | GUuAGCGGuAUUUUGCCGGTsT | AD-11780 |
| 379-397 | VP35 | A18958 | 415 | AGcuGuGcGucGGcAAAccTsT | A18959 | 416 | GGUUUGCCGACGcACAGCUTsT | AD-11781 |
| 646-664 | VP35 | A18960 | 417 | AuuGAAAGAuccGAAcGGGTsT | A18961 | 418 | CCCGUUCGGAUCUUUcAAUTsT | AD-11782 |
| 731-749 | VP35 | A18962 | 419 | AAuuucGGGcGAccuuAcATsT | A18963 | 420 | UGuAAGGUCGCCCGAAAUUTsT | AD-11783 |
| 732-750 | VP35 | A18964 | 421 | AuuucGGGcGAccuuAcAuTsT | A18965 | 422 | AUGUAAGGUCGCCCGAAAUTsT | AD-11784 |
| 1193-1211 | VP35 | A18966 | 423 | GucuAuuGuGucAuAAGcuTsT | A18967 | 424 | AGCUuAUGAcAcAAuAGACTsT | AD-11785 |
| 438-456 | VP40 | A18968 | 425 | cucGcAucuuAuAcGAucATsT | A18969 | 426 | UGAUCGuAuAAGAUGCGAGTsT | AD-11786 |
| 1301-1319 | VP40 | A18970 | 427 | uGcAuAAGcGAuccAuAcuTsT | A18971 | 428 | AGuAUGGAUCGCUuAUGcATsT | AD-11787 |
| 1191-1209 | VP40 | A18972 | 429 | AAuGuAcuAAucGGGucAATsT | A18973 | 430 | UUGACCCGAUuAGuAcAUUTsT | AD-11788 |
| 442-460 | VP40 | A18974 | 431 | cAucuuAuAcGAucAcccATsT | A18975 | 432 | UGGGUGAUCGuAuAAGAUGTsT | AD-11789 |
| 443-461 | VP40 | A18976 | 433 | AucuuAuAcGAucAcccAuTsT | A18977 | 434 | AUGGGUGAUCGuAuAAGAUTsT | AD-11790 |
| 478-496 | VP40 | A18978 | 435 | AcccccucGuuAGAGuGAATsT | A18979 | 436 | UUcACUCuAACGAGGGGGUTsT | AD-11791 |
| 834-852 | VP40 | A18980 | 437 | AucGuGccAAuuGAuccAGTsT | A18981 | 438 | CUGGAUcAAUUGGcACGAUTsT | AD-11792 |
| 1192-1210 | VP40 | A18982 | 439 | AuGuAcuAAucGGGucAAGTsT | A18983 | 440 | CUUGACCCGAUuAGuAcAUTsT | AD-11793 |
| 1194-1212 | VP40 | A18984 | 441 | GuAcuAAucGGGucAAGGATsT | A18985 | 442 | UCCUUGACCCGAUuAGuACTsT | AD-11794 |
| 1300-1318 | VP40 | A18986 | 443 | AuGcAuAAGcGAuccAuAcTsT | A18987 | 444 | GuAUGGAUCGCUuAUGcAUTsT | AD-11795 |
| 465-483 | GP | A18988 | 445 | AcGGGAGcGAAuGcuuAccTsT | A18989 | 446 | GGuAAGcAUUCGCUCCCGUTsT | AD-11796 |
| 358-376 | VP30 | A18990 | 447 | AGuuAGAGucccuAcGGuuTsT | A18991 | 448 | AACCGuAGGGACUCuAACUTsT | AD-11797 |
| 331-349 | VP30 | A18992 | 449 | cuAccGuAGuAGucGAAGuTsT | A18993 | 450 | ACUUCGACuACuACGGuAGTsT | AD-11798 |
| 250-268 | VP30 | A18994 | 451 | GAAUUcAcGuGccGAccAGTsT | A18995 | 452 | CUGGUCGGcACGUGAAUUCTsT | AD-11799 |
| 1009-1027 | VP30 | A18996 | 453 | uGccccccAAGcGuuAAuTsT | A18997 | 454 | AUuAACGCUUGGGGGGGcATsT | AD-11800 |
| 1318-1336 | VP30 | A18998 | 455 | AGAGuGuuAGGAucGuUAuTsT | A18999 | 456 | AuAACGAUCCuAACACUCUTsT | AD-11801 |
| 126-144 | VP30 | A19000 | 457 | AAucccGAGOcGGcAAuucTsT | A19001 | 458 | GAAuuGCCGCCUCGGGAuUTsT | AD-11802 |
| 354-372 | VP30 | A19002 | 459 | CGCAAGUUAGAGUCCCUACTsT | A19003 | 460 | GuAGGGACUCuAACUUGCGTsT | AD-11803 |
| 553-571 | VP30 | A19004 | 461 | uGAuucAucGcuuAAuAuATsT | A19005 | 462 | uAuAUuAAGCGAUGAAUcATsT | AD-11804 |
| 583-601 | VP30 | A19006 | 463 | AGAccuAAGAcuAGcAAAuTsT | A19007 | 464 | AUUUGCuAGUCUuAGGUCUTsT | AD-11805 |
| 652-670 | VP30 | A19008 | 465 | AuuAcuAGucGAGAcuGcuTsT | A19009 | 466 | AGcAGUCUCGACuAGuAAUTsT | AD-11806 |
| 992-1010 | VP30 | A19010 | 467 | ucAGGccuAcGcuuAcuuGTsT | A19011 | 468 | cAAGuAAGCGuAGGCCUGATsT | AD-11807 |
| 1013-1031 | VP30 | A19012 | 469 | ccccCAAGcGuuAAuGAAGTsT | A19013 | 470 | CUUcAUuAACGCUUGGGGGTsT | AD-11808 |
| 404-422 | VP24 | A19014 | 471 | AuuAuAcGGGuccAuuAAuTsT | A19015 | 472 | AUuAAUGGACCCGuAuAAUTsT | AD-11809 |
| 888-906 | VP24 | A19016 | 473 | cucAAcGAGuAAAGGAccATsT | A19017 | 474 | UGGUCCUUuACUCGUUGAGTsT | AD-11810 |
| 1247-1265 | VP24 | A19018 | 475 | uuGUAcGAuAGGGcuAAcATsT | A19019 | 476 | UGUuAGCCCuAUCGuAcAATsT | AD-11811 |
| 536-554 | VP24 | A19020 | 477 | GuuGuGuuuAGcGAccuAuTsT | A19021 | 478 | AuAGGUCGCuAAAcAcAACTsT | AD-11812 |
| 1050-1068 | VP24 | A19022 | 479 | GGACUAAUAuGGGuuAucuTsT | A19023 | 480 | AGAuAACCcAuAUuAGUCCTsT | AD-11813 |
| 1095-1113 | VP24 | A19024 | 481 | CUGCGAUGGAUAUACGACATsT | A19025 | 482 | UGUCGuAuAUCcAUCGcAGTsT | AD-11814 |
| 535-553 | VP24 | A19026 | 483 | AGuuGuGuuuAGcGAccuATsT | A19027 | 484 | uAGGUCGCuAAAcAcAACUTsT | AD-11815 |

TABLE 2-continued

| position in target | Target | double overhang design sense strand | | | antisense strand | | | duplex name |
|---|---|---|---|---|---|---|---|---|
| | | name | Seq ID | sequence (5'-3') | name | Seq ID | sequence (5'-3') | |
| 196-214 | VP24 | A19028 | 485 | uuGAAcuAGucuAcucGcATsT | A19029 | 486 | UGCGAGuAGACuAGUUcAATsT | AD-11816 |
| 215-233 | VP24 | A19030 | 487 | GAAUCCUACCGGGAAUAGATsT | A19031 | 488 | UCuAUUCCCGGuAGGAUUCTsT | AD-11817 |
| 403-421 | VP24 | A19032 | 489 | uAuuAuAcGGGuccAuuAATsT | A19033 | 490 | UuAAUGGACCCGuAuAAuATsT | AD-11818 |
| 406-424 | VP24 | A19034 | 491 | uAuAcGGGuccAuuAAuuuTsT | A19035 | 492 | AAAuuAAUGGACCCGuAuATsT | AD-11819 |
| 1140-1158 | VP24 | A19036 | 493 | uAcAuGAAuCGAcAcuuAATsT | A19037 | 494 | UuAAGUGUCGAUUcAUGuATsT | AD-11820 |
| 1243-1261 | VP24 | A19038 | 495 | AAAAuuGuAcGAuAGGGcuTsT | A19039 | 496 | AGCCCuAUCGuAcAAUUUUTsT | AD-11821 |
| 1249-1267 | VP24 | A19040 | 497 | GuAcGAuAGGGcuAAcAuuTsT | A19041 | 498 | AAUGUuAGCCCuAUCGuACTsT | AD-11822 |
| 1590-1608 | VP24 | A19042 | 499 | GAGcccAAAuuAAcAcGGuTsT | A19043 | 500 | ACCGUGUuAAUUUGGGCUCTsT | AD-11823 |
| 3688-3706 | L | A19044 | 501 | ccCGcuAuuAAGccGAGGuTsT | A19045 | 502 | ACCUCGGCUuAAuAGCGGGTsT | AD-11824 |
| 3687-3705 | L | A19046 | 503 | GcccGcuAuuAAGccGAGGTsT | A19047 | 504 | CCUCGGCUuAAuAGCGGGCTsT | AD-11825 |
| 2956-2974 | L | A19048 | 505 | AAuuGuAGcGcAAuuGAcuTsT | A19049 | 506 | AGUcAAUUGCGCuAcAAUUTsT | AD-11826 |
| 2615-2633 | L | A19050 | 507 | AGcGAucAAucuccGAAAcTsT | A19051 | 508 | GuuUCGGAGAuuGAUCGCUTsT | AD-11827 |
| 2612-2630 | L | A19052 | 509 | uuGAGcGAucAAucuccGATsT | A19053 | 510 | UCGGAGAUUGAUCGCUcAATsT | AD-11828 |
| 4595-4613 | L | A19054 | 511 | uucGAAucuucAAAccGAcTsT | A19055 | 512 | GUCGGuuuGAAGAuUCGAATsT | AD-11829 |
| 2613-2631 | L | A19056 | 513 | uGAGcGAucAAucuCCGAATsT | A19057 | 514 | UUCGGAGAUUGAUCGCUcATsT | AD-11830 |
| 2614-2632 | L | A19058 | 515 | GAGcGAucAAucuccGAAATsT | A19059 | 516 | uuUCGGAGAuuGAUCGCUCTsT | AD-11831 |
| 3941-3959 | L | A19060 | 517 | CAAcGcGcuuGAuGGuAucTsT | A19061 | 518 | GAuACcAUcAAGCGCGUUGTsT | AD-11832 |
| 3942-3960 | L | A19062 | 519 | AAcGcGcuuGAuGGuAucuTsT | A19063 | 520 | AGAuACcAUcAAGCGCGUUTsT | AD-11833 |
| 1680-1698 | L | A19064 | 521 | AuACGcCcAAGAAcuuAGGTsT | A19065 | 522 | CCuAAGUUCUUGGGCGuAUTsT | AD-11834 |
| 3686-3704 | L | A19066 | 523 | AGcccGcuAuuAAGccGAGTsT | A19067 | 524 | CUCGGCUuAAuAGCGGGCUTsT | AD-11835 |
| 4255-4273 | L | A19068 | 525 | uuAucGAuuGAcAGuccuuTsT | A19069 | 526 | AAGGACUGUcAAUCGAuAATsT | AD-11836 |
| 1374-1392 | L | A19070 | 527 | AGAccGAuGuuuAAcGccGTsT | A19071 | 528 | CGGCGUuAAAcAUCGGUCUTsT | AD-11837 |
| 5470-5488 | L | A19072 | 529 | AccAuAuAuuuGucGcuucATsT | A19073 | 530 | UGAAGCGAcAAuAuAUGGUTsT | AD-11838 |
| 3872-3890 | L | A19074 | 531 | AuAuuGuGcAucGGuAuAATsT | A19075 | 532 | UuAUACCGAUGCAcAAuAUTsT | AD-11839 |
| 1384-1402 | L | A19076 | 533 | uuAAcGccGGGAuuGAAuuTsT | A19077 | 534 | AAUUcAAUCCCGGCGuuAATsT | AD-11840 |
| 4519-4537 | L | A19078 | 535 | UGCACGAAAAAGAUCGGACTsT | A19079 | 536 | GUCCGAUCUUUUUCGUGcATsT | AD-11841 |
| 3682-3700 | L | A19080 | 537 | GGucAGcccGcuAuuAAGcTsT | A19081 | 538 | GCUuAAuAGCGGGCUGACCTsT | AD-11842 |
| 2954-2972 | L | A19082 | 539 | GGAAuuGuAGcGcAAuuGATsT | A19083 | 540 | UcAAUUGCGCuAcAAUUCCTsT | AD-11843 |
| 5467-5485 | L | A19084 | 541 | AcuAccAuAuAuuuGucGcuTsT | A19085 | 542 | AGCGAcAAuAuAUGGuAGUTsT | AD-11844 |
| 1376-1394 | L | A19086 | 543 | AccGAuGuuuAAcGccGGGTsT | A19087 | 544 | CCCGGCGUuAAAcAUCGGUTsT | AD-11845 |
| 2448-2466 | L | A19088 | 545 | uGAuGAGAcuuucGuAcAcTsT | A19089 | 546 | GUGuACGAAAGUCUcAUcATsT | AD-11846 |
| 1023-1041 | L | A19090 | 547 | AcGAAAAGGGcGGuuuuuATsT | A19091 | 548 | uAAAAACCGCCCUUUUCGUTsT | AD-11847 |
| 1377-1395 | L | A19092 | 549 | ccGAuGuuuAAcGccGGGATsT | A19093 | 550 | UCCCGGCGUuAAAcAUCGGTsT | AD-11848 |
| 2619-2637 | L | A19094 | 551 | AucAAuCuCCGAAAcuAGATsT | A19095 | 552 | UCuAGUUUCGGAGAUUGAUTsT | AD-11849 |
| 5608-5626 | L | A19096 | 553 | AAAuAcGGcGuuAAGAAGuTsT | A19097 | 554 | ACUUCUuAACGCCGuAUUUTsT | AD-11850 |
| 5607-5625 | L | A19098 | 555 | AAAAuAcGGCGuuAAGAAGTsT | A19099 | 556 | CUUCUuAACGCCGuAUUUUTsT | AD-11851 |
| 6396-6414 | L | A19100 | 557 | ucGAAcccAGAcuuAucAuTsT | A19101 | 558 | AUGAuAAGUCUGGGUUCGATsT | AD-11852 |

TABLE 2-continued

| position in target | Target | double overhang design sense strand | | | antisense strand | | | duplex name |
|---|---|---|---|---|---|---|---|---|
| | | name | Seq ID | sequence (5'-3') | name | Seq ID | sequence (5'-3') | |
| 4165-4183 | L | A19102 | 559 | AcAAccAcGcuAAAucUAGTsT | A19103 | 560 | CuAGAUUuAGCGUGGUUGUTsT | AD-11853 |
| 4250-4268 | L | A19104 | 561 | GcAAcuuAucGAuuGAcAGTsT | A19105 | 562 | CUGUcAAUCGAuAAGUUGCTsT | AD-11854 |
| 6434-6452 | L | A19106 | 563 | GAcGGAuAAcuAAAcuAGuTsT | A19107 | 564 | ACuAGUUuAGUuAUCCGUCTsT | AD-11855 |
| 2959-2977 | L | A19108 | 565 | uGuAGcGcAAuuGAcutauGTsT | A19109 | 566 | cAAAGUcAAUUGCGCuAcATsT | AD-11856 |
| 6433-6451 | L | A19110 | 567 | GGAcGGAuAAcuAAAcuAGTsT | A19111 | 568 | CuAGUUuAGUuAUCCGUCCTsT | AD-11857 |
| 83-101 | L | A19112 | 569 | uGGcuAcccAAcAuAcAcATsT | A19113 | 570 | UGUGuAUGUUGGGuAGCcATsT | AD-11858 |
| 1382-1400 | L | A19114 | 571 | GuuuAAcGccGGGAuuGAATsT | A19115 | 572 | UUcAAUCCCGGCGUuAAACTsT | AD-11859 |
| 1014-1032 | NP | A19116 | 573 | uuuccGuuuGAuGcGAAcATsT | A19117 | 574 | UGUUCGcAUcAAACGGAAATsT | AD-11860 |
| 1805-1823 | NP | A19118 | 575 | GAAGcuAcGGcGAAuAccATsT | A19119 | 576 | UGGuAUUCGCCGuAGCUUCTsT | AD-11861 |
| 1862-1880 | NP | A19120 | 577 | uGGuccuAuucGAucuAGATsT | A19121 | 578 | UCuAGAUCGAAuAGGACcATsT | AD-11862 |
| 1016-1034 | NP | A19122 | 579 | uccGuuuGAuGcGAAcAAATsT | A19123 | 580 | UUUGUUCGcAUcAAACGGATsT | AD-11863 |
| 2230-2248 | NP | A19124 | 581 | ccAccGGcucccGuAuAcATsT | A19125 | 582 | UGuAuACGGGAGCCGGUGGTsT | AD-11864 |
| 2233-2251 | NP | A19126 | 583 | ccGGcucccGuAuAcAGAGTsT | A19127 | 584 | CUCUGuAuACGGGAGCCGGTsT | AD-11865 |
| 959-977 | NP | A19136 | 585 | AAGGAcuGAuACAAuAuccTsT | A19137 | 586 | GGAuAUUGuAUcAGUCCUUTsT | AD-11870 |
| 1017-1035 | NP | A19138 | 587 | ccGuuuGAuGcGAAcAAAuTsT | A19139 | 588 | AUUUGUUCGcAUcAAACGGTsT | AD-11871 |
| 2124-2142 | NP | A19140 | 589 | cccAcuGGAcGAuGccGAcTsT | A19141 | 590 | GUCGGcAUCGUCcAGUGGGTsT | AD-11872 |
| 745-763 | NP | A19142 | 591 | cGuGAuGGAGuGAAGcGccTsT | A19143 | 592 | GGCGCUUcACUCcAUcACGTsT | AD-11873 |
| 2229-2247 | NP | A19144 | 593 | cccAccGGcucccGuAuAcTsT | A19145 | 594 | GuAuACGGGAGCCGGUGGGTsT | AD-11874 |
| 2119-2137 | NP | A20118 | 595 | GcAGAcccAcuGGAcGAuGTsT | A20119 | 596 | cAUCGUCcAGUGGGUCUGCTsT | AD-12462 |
| 1587-1605 | NP | A20120 | 597 | AAAcGcuAuGGuAAcucuATsT | A20121 | 598 | uAGAGUuACcAuAGCGUUUTsT | AD-12463 |
| 1300-1318 | NP | A20122 | 599 | uucGcccGAcuuuuGAAccTsT | A20123 | 600 | GGUUcAAAAGUCGGGCGAATsT | AD-12464 |
| 1808-1826 | NP | A20124 | 601 | GcuAcGGcGAAuAccAGAGTsT | A20125 | 602 | CUCUGGuAUUCGCCGuAGCTsT | AD-12465 |
| 1813-1831 | NP | A20126 | 603 | GGcGAAuAccAGAGuuAcuTsT | A20127 | 604 | AGuAACUCUGGuAUUCGCCTsT | AD-12466 |
| 532-550 | VP35 | A19146 | 605 | GGuGAuGAcAAccGGucGGTsT | A19147 | 606 | CCGACCGGUUGUcAUcACCTsT | AD-11875 |
| 417-435 | VP35 | A19148 | 607 | uAGAAcAAcGcAuuAcGAGTsT | A19149 | 608 | CUCGuAAUGCGUUGUUCuATsT | AD-11876 |
| 741-759 | VP35 | A19152 | 609 | GGAAccuGAcAuuucGGcTsT | A19153 | 610 | GCCGAAAUGUcAGGUUUCCTsT | AD-11878 |
| 1049-1067 | VP35 | A19154 | 611 | cccAAGAuuGAucGAGGuuTsT | A19155 | 612 | AACCUCGAUcAAUCUUGGGTsT | AD-11879 |
| 206-224 | VP35 | A19160 | 613 | AGAAuuccuGuAAGCGAcATsT | A19161 | 614 | UGUCGCUuAcAGGAAUUCTsT | AD-11882 |
| 246-264 | VP35 | A19162 | 615 | AUCCAGGAUUAUGCUACGCTsT | A19163 | 616 | GCGuAGcAuAAUCCUGGAUTsT | AD-11883 |
| 247-265 | VP35 | A19164 | 617 | uCcAGGAuuAuGcuAcGcATsT | A19165 | 618 | UGCGuAGcAuAAUCCUGGATsT | AD-11884 |
| 287-305 | VP35 | A19166 | 619 | CCAAACCCGAAGACGCGCATsT | A19167 | 620 | uGCGCGUCuUCGGGuuuGGTsT | AD-11885 |
| 314-332 | VP35 | A19168 | 621 | AcccAAAcCGAcccAAuuuTsT | A19169 | 622 | AAAuuGGGUCCGuuuGGGUTsT | AD-11886 |
| 319-337 | VP35 | A19170 | 623 | AAcGGAcccAAuuuGcAAuTsT | A19171 | 624 | AUUGcAAAUUGGGUCCGUUTsT | AD-11887 |
| 414-432 | VP35 | A19172 | 625 | cAuuAGAAcAAcGcAuuAcTsT | A19173 | 626 | GuAAUGCGUUGUUCuAAUGTsT | AD-11888 |
| 415-433 | VP35 | A19174 | 627 | AuuAGAAcAAcGcAuuAcGTsT | A19175 | 628 | CGuAAUGCGUUGUUCuAAUTsT | AD-11889 |
| 439-457 | VP35 | A19176 | 629 | uGAGAAuGGucuAAAGccATsT | A19177 | 630 | UGGCUUuAGACcAUUCUcATsT | AD-11890 |

TABLE 2-continued

| position in target | Target | double overhang design sense strand | | | antisense strand | | | duplex name |
|---|---|---|---|---|---|---|---|---|
| | | name | Seq ID | sequence (5'-3') | name | Seq ID | sequence (5'-3') | |
| 576-594 | VP35 | A19178 | 631 | AGGcuUAuUGGGccGAAcATsT | A19179 | 632 | UGUUCGGCCcAAuAAGCCUUsT | AD-11891 |
| 413-431 | VP35 | A20128 | 633 | ucAuuAGAAcAAcGcAuuATsT | A20129 | 634 | uAAUGCGUUGUUCuAAUGATsT | AD-12467 |
| 583-601 | VP35 | A20130 | 635 | UUGGGCCGAACAUGGUCAATsT | A20131 | 636 | UUGAccAUGUUCGGCCcAATsT | AD-12468 |
| 983-1001 | VP35 | A20132 | 637 | cAcAuccGcucucGAGCuGTsT | A20133 | 638 | cACCUCGAGAGCGGAUGUGTsT | AD-12469 |
| 318-336 | VP35 | A20134 | 639 | AAAcGGAcccAAuuuGcAATsT | A20135 | 640 | UUGcAAAUUGGGUCCGUUUTsT | AD-12470 |
| 420-438 | VP35 | A20136 | 641 | AAcAAcGcAuuAcGAGucuTsT | A20137 | 642 | AGACUCGuAAUGCGUUGUUTsT | AD-12471 |
| 419-437 | VP35 | A20138 | 643 | GAAcAAcGcAuuAcGAGucTsT | A20139 | 644 | GACUCGuAAUGCGUUGUUCTsT | AD-12472 |
| 134-152 | VP35 | A20140 | 645 | GccAcGAcucAAAAcGAcATsT | A20141 | 646 | UGUCGUUUUGAGUCGUGGCTsT | AD-12473 |
| 893-911 | VP40 | A19180 | 647 | ccAcAAGcuGAccGGuAAGTsT | A19181 | 648 | CUuACCGGUcAGCUUGUGGTsT | AD-11892 |
| 892-910 | VP40 | A19182 | 649 | uccAcAAGCuGAccGGuAATsT | A19183 | 650 | UuACCGGUcAGCUUGUGGATsT | AD-11893 |
| 325-343 | VP40 | A19188 | 651 | uGAAuGucAuAucGGGcccTsT | A19189 | 652 | GGGCCCGAuAUGAcAUUcATsT | AD-11896 |
| 450-468 | VP40 | A19190 | 653 | AcuAucAcccAuuucGGcATsT | A19191 | 654 | UGCCGAAAUGGGUGAuAGTsT | AD-11897 |
| 662-680 | VP40 | A19194 | 655 | GAccGAuGAcAcuccAAcATsT | A19195 | 656 | UGUUGGAGUGUcAUCGGUCTsT | AD-11899 |
| 200-218 | VP40 | A19198 | 657 | GAcAccGGAGucAGucAAuTsT | A19199 | 658 | AuuGAcuGACUCCGGuGUCTsT | AD-11901 |
| 203-221 | VP40 | A19200 | 659 | AccGGAGucAGucAAuGGGTsT | A19201 | 660 | CCcAUUGAcuGACUCCGGUTsT | AD-11902 |
| 204-222 | VP40 | A19202 | 661 | ccGGAGucAGucAAuGGGGTsT | A19203 | 662 | CCCCAUUGACUGACUCCGGTsT | AD-11903 |
| 225-243 | VP40 | A19204 | 663 | AcuccAucGAAuccAcucATsT | A19205 | 664 | uGAGuGGAuUCGAuGGAGUTsT | AD-11904 |
| 386-404 | VP40 | A19206 | 665 | uGucGcuGAucAAAAGACcTsT | A19207 | 666 | GGUCUUUUGAUcAGCGAcATsT | AD-11905 |
| 584-602 | VP40 | A19208 | 667 | AGuccAAcuAcccAGuAuTsT | A19209 | 668 | AuACGGGGuAGUUGGACUTsT | AD-11906 |
| 631-649 | VP40 | A19210 | 669 | uGAucAcccAAccAcuGccTsT | A19211 | 670 | GGcAGUGGUUGGGUGAUcATsT | AD-11907 |
| 660-678 | VP40 | A19212 | 671 | uGGAccGAuGAcAcuccAATsT | A19213 | 672 | UUGGAGUGUcAUCGGUCcATsT | AD-11908 |
| 663-681 | VP40 | A19214 | 673 | AccGAuGAcAcucCAAcAGTsT | A19215 | 674 | CUGUUGGAGUGUcAUCGGUTsT | AD-11909 |
| 929-947 | VP40 | A19218 | 675 | uGGAcAAccAAucAucccuTsT | A19219 | 676 | AGGGAUGAUUGGUUGUCCATsT | AD-11911 |
| 1019-1037 | VP40 | A19220 | 677 | uuGuGAcAcGuGucAuucuTsT | A19221 | 678 | AGAAUGAcACGUGUcAcAATsT | AD-11912 |
| 243-261 | VP40 | A19224 | 679 | AGGccAAuuGccGAuGAcATsT | A19225 | 680 | UGUcAUCGGcAAUUGGCCUTsT | AD-11914 |
| 140-158 | VP40 | A20142 | 681 | AuAcccuGucAGGucAAAuTsT | A20143 | 682 | AUUUGACCUGAcAGGGuAUTsT | AD-12474 |
| 141-159 | VP40 | A20144 | 683 | uAcccuGucAGGucAAAuuTsT | A20145 | 684 | AAUUUGACCUGAcAGGGuATsT | AD-12475 |
| 378-396 | VP40 | A20146 | 685 | ccucuAGGuGucGcuGAucTsT | A20147 | 686 | GAUCAGCGACACCuAGAGGTsT | AD-12476 |
| 427-445 | VP40 | A20148 | 687 | ccGccAucAuGcuuGcuucTsT | A20149 | 688 | GAAGcAAGcAUGAUGGCGGTsT | AD-12477 |
| 898-916 | VP40 | A20150 | 689 | AGcuGAccGGuAAGAAGGuTsT | A20151 | 690 | ACCUUCUuACCGGUcAGCUTsT | AD-12478 |
| 199-217 | VP40 | A20152 | 691 | uGAcAccGGAGucAGucAATsT | A20153 | 692 | UUGACUGACUCCGGUGUcATsT | AD-12479 |
| 568-586 | VP40 | A20154 | 693 | AGuucGuucuuccGccAGuTsT | A20155 | 694 | ACUGGCGGAAGAACGAACUTsT | AD-12480 |
| 569-587 | VP40 | A20156 | 695 | GuucGuucuuccGccAGucTsT | A20157 | 696 | GACUGGCGGAAGAACGAACTsT | AD-12481 |
| 1728-1746 | GP | A19232 | 697 | ccuGGAuAccAuAuuucGGTsT | A19233 | 698 | CCGAAAuAUGGuAUCcAGGTsT | AD-11918 |
| 1729-1747 | GP | A19234 | 699 | cuGGAuAccAuAuuucGGGTsT | A19235 | 700 | CCCGAAAuAUGGuAUCcAGTsT | AD-11919 |
| 1818-1836 | GP | A19246 | 701 | AGcuGGccAAcGAGAcGAcTsT | A19247 | 702 | GUCGUCUCGUUGGCcAGCUTsT | AD-11925 |
| 1821-1839 | GP | A19248 | 703 | uGGccAAcGAGAcGAcucATsT | A19249 | 704 | UGAGUCGUCUCGUUGGCcATsT | AD-11926 |

TABLE 2-continued

| position | | double overhang design sense strand | | | antisense strand | | | |
|---|---|---|---|---|---|---|---|---|
| in target | Target | name | Seq ID | sequence (5'-3') | name | Seq ID | sequence (5'-3') | duplex name |
| 1732-1750 | GP | A19250 | 705 | GAuAccAuAuuucGGGccATsT | A19251 | 706 | UGGCCCGAAAuAUGGuAUCTsT | AD-11927 |
| 1956-1974 | GP | A20158 | 707 | cGGAcuGcuGuAucGAAccTsT | A20159 | 708 | GGUUCGAuAcAGcAGUCCGTsT | AD-12482 |
| 2107-2125 | GP | A20160 | 709 | uGGAGuuAcAGGcGuuAuATsT | A20161 | 710 | uAuAACGCCUGuAACUCCATsT | AD-12483 |
| 2124-2142 | GP | A20162 | 711 | uAAuuGcAGuuAucGcuuuTsT | A20163 | 712 | AAAGCGAuAACUGcAAUuATsT | AD-12484 |
| 2109-2127 | GP | A20164 | 713 | GAGuuACAGGcGuuAuAAuTsT | A20165 | 714 | AUuAuAACGCCUGuAACUCTsT | AD-12485 |
| 1958-1976 | GP | A20166 | 715 | GAcuGcuGuAucGAAccAcTsT | A20167 | 716 | GUGGUUCGAuAcAGcAGUCTsT | AD-12486 |
| 1890-1908 | GP | A20168 | 717 | uccucAAccGuAAGGcAAuTsT | A20169 | 718 | AUUGCCUuACGGUUGAGGATsT | AD-12487 |
| 1891-1909 | GP | A20170 | 719 | ccucAAccGuAAGGcAAuuTsT | A20171 | 720 | AAUUGCCUuACGGUUGAGGTsT | AD-12488 |
| 1307-1325 | GP | A20172 | 721 | AAuAcAcccGuGuAuAAAcTsT | A20173 | 722 | GUUuAuAcACGGGUGuAUUTsT | AD-12489 |
| 1823-1841 | GP | A20174 | 723 | GccAAcGAGAcGAcucAAGTsT | A20175 | 724 | CUUGAGUCGUCUCGUUGGCTsT | AD-12490 |
| 2110-2128 | GP | A20176 | 725 | AGuuAcAGGcGuuAuAAuuTsT | A20177 | 726 | AAUuAuAACGCCUGuAACUTsT | AD-12491 |
| 1308-1326 | GP | A20178 | 727 | AuAcAcccGuGuAuAAAcuTsT | A20179 | 728 | AGUUuAuAcACGGGUGuAUTsT | AD-12492 |
| 2113-2131 | GP | A20180 | 729 | uAcAGGcGuuAuAAuuGcATsT | A20181 | 730 | UGCAAUuAuAACGCCUGuATsT | AD-12493 |
| 1654-1672 | GP | A20182 | 731 | cAAuGcucAAcccAAAuGcTsT | A20183 | 732 | GcAUUUGGGUUGAGcAUUGTsT | AD-12494 |
| 1824-1842 | GP | A20184 | 733 | ccAAcGAGAcGAcucAAGcTsT | A20185 | 734 | GCUUGAGUCGUCUCGUUGGTsT | AD-12495 |
| 1313-1331 | GP | A20186 | 735 | cccGuGuAuAAAcuuGAcATsT | A20187 | 736 | UGUcAAGUUuAuAcACGGGTsT | AD-12496 |
| 1873-1891 | GP | A20188 | 737 | GcuAcGcAccuuuucAAucTsT | A20189 | 738 | GAUUGAAAAGGUGCGuAGCTsT | AD-12497 |
| 1953-1971 | GP | A20190 | 739 | GAccGGAcuGcuGuAucGATsT | A20191 | 740 | UCGAuAcAGcAGUCCGGUCTsT | AD-12498 |
| 1964-1982 | GP | A20192 | 741 | uGuAucGAAccAcAuGAuuTsT | A20193 | 742 | AAUcAUGUGGUUCGAuAcATsT | AD-12499 |
| 329-347 | VP30 | A20194 | 743 | AGGuGAGuAccGucAAucATsT | A20195 | 744 | UGAUUGACGGuACUcACCUTsT | AD-12500 |
| 426-444 | VP30 | A20196 | 745 | AAAGAcAuAuGuccGAccuTsT | A20197 | 746 | AGGUCGGAcAuAUGUCUUUTsT | AD-12501 |
| 842-860 | VP30 | A20198 | 747 | ucucGAAGuAuAucAAcGATsT | A20199 | 748 | UCGUUGAuAuACUUCGAGATsT | AD-12502 |
| 909-927 | VP30 | A20200 | 749 | uGGGAccGAcAAucccuAATsT | A20201 | 750 | UuAGGGAUUGUCGGUCCcATsT | AD-12506 |
| 523-541 | VP30 | A20202 | 751 | uccuAcuAAucGcccGuAATsT | A20203 | 752 | UuACGGGCGAUuAGuAGGATsT | AD-12504 |
| 429-447 | VP30 | A20204 | 753 | GAcAuAuGuccGAccuuGATsT | A20205 | 754 | UcAAGGUCGGAcAuAUGUCTsT | AD-12505 |
| 521-539 | VP30 | A20206 | 755 | AcuccuAcuAAucGcccGuTsT | A20207 | 756 | ACGGGCGAUUAGuAGGAGUTsT | AD-12506 |
| 903-921 | VP30 | A20208 | 757 | CAAcAAuGGGAccGAcAAuTsT | A20209 | 758 | AUUGUCGGUCCcAUUGUUGTsT | AD-12507 |
| 355-373 | VP30 | A20210 | 759 | ccucAcAAGuGcGcGuuccTsT | A20211 | 760 | GGAACGCGcACUUGUGAGGTsT | AD-12508 |
| 337-355 | VP30 | A20212 | 761 | AccGucAAucAAGGAGcGcTsT | A20213 | 762 | GCGCUCCUUGAUUGACGGUTsT | AD-12509 |
| 908-926 | VP24 | A19262 | 763 | cuGucGuuGAuucGAuccATsT | A19263 | 764 | UGGAUCGAAUcAACGAcAGTsT | AD-11933 |
| 522-540 | VP24 | A19272 | 765 | uuGucuuAAGcGAccucuGTsT | A19273 | 766 | cAGAGGUCGCUuAAGAcAATsT | AD-11938 |
| 790-808 | VP24 | A19274 | 767 | uuuGAuuGAAcccuuAGcATsT | A19275 | 768 | UGCuAAGGGUUcAAUcAAATsT | AD-11939 |
| 863-881 | VP24 | A20214 | 769 | AAcAuGcGAAcACAAcGuGTsT | A20215 | 770 | cACGUUGUGUUCGcAUGUUTsT | AD-12510 |
| 1102-1120 | VP24 | A20216 | 771 | uGGGccGGcGAAAuuuuccTsT | A20217 | 772 | GGAAAAUUUCGCCGGCCcATsT | AD-12511 |
| 912-930 | VP24 | A20218 | 773 | cGuuGAuucGAuccAAuAuTsT | A20219 | 774 | AuAUUGGAUCGAAUCAACGTsT | AD-12512 |
| 954-972 | VP24 | A20220 | 775 | AuGcucuAcAuGucGuGAATsT | A20221 | 776 | UUcACGAcAUGuAGAGcAUTsT | AD-12513 |

TABLE 2-continued

| position in target | Target | double overhang design sense strand | | | antisense strand | | | duplex name |
|---|---|---|---|---|---|---|---|---|
| | | name | Seq ID | sequence (5'-3') | name | Seq ID | sequence (5'-3') | |
| 475-493 | VP24 | A20222 | 777 | GGGAcGAuAcAAucuAAuATsT | A20223 | 778 | uAUuAGAUUGuAUCGUCCCTsT | AD-12514 |
| 1069-1087 | VP24 | A20224 | 779 | AcccGAcAAAucGGcAAuGTsT | A20225 | 780 | cAUUGCCGAUUUGUCGGGUTsT | AD-12515 |
| 486-504 | VP24 | A20226 | 781 | AucuAAuAucGcccAAAAATsT | A20227 | 782 | UUUUUGGGCGAuAUuAGAUTsT | AD-12516 |
| 525-543 | VP24 | A20228 | 783 | ucuuAAGcGAccucuGuAATsT | A20229 | 784 | UuAcAGAGGUCGCUuAAGATsT | AD-12517 |
| 867-885 | VP24 | A20230 | 785 | uGcGAAcAcAAcGuGucAATsT | A20231 | 786 | UUGAcACGUUGUGUUCGcATsT | AD-12518 |
| 1028-1046 | VP24 | A20232 | 787 | AuAAcucGAAcuAAcAuGGTsT | A20233 | 788 | CcAUGUuAGUUCGAGUuAUTsT | AD-12519 |
| 471-489 | VP24 | A20234 | 789 | cuAcGGGAcGAuAcAAucuTsT | A20235 | 790 | AGAUUGuAUCGUCCCGuAGTsT | AD-12520 |
| 1029-1047 | VP24 | A20236 | 791 | uAAcucGAAcuAAcAuGGGTsT | A20237 | 792 | CCcAUGUuAGUUCGAGUuATsT | AD-12521 |
| 1948-1966 | L | A20238 | 793 | cAGuuAGGGGAGuAGcuuTsT | A20239 | 794 | AAGCuACUCCCUCuAACUGTsT | AD-12522 |
| 2003-2021 | L | A20240 | 795 | AuAuGAGuuuAcAGcAccuTsT | A20241 | 796 | AGGUGCUGuAAACUcAUAUTsT | AD-12523 |
| 2005-2023 | L | A20242 | 797 | AuGAGuuuAcAGcAccuuuTsT | A20243 | 798 | AAAGGUGCUGuAAACUcAUTsT | AD-12524 |
| 2070-2088 | L | A20244 | 799 | uGGAuGcAuuAuAcAAuccTsT | A20245 | 800 | GGAUUGuAuAAUGcAUCcATsT | AD-12525 |
| 1959-1977 | NP | A19278 | 801 | AccuuGGAcGGAGcGAAAATsT | A19279 | 802 | UUUUCGCUCCGUCcAAGGUTsT | AD-11941 |
| 1687-1705 | NP | A19280 | 803 | cAuuucccGGGccGAucuATsT | A19281 | 804 | uAGAUCGGCCCGGGAAAUGTsT | AD-11942 |
| 1775-1793 | NP | A19282 | 805 | uGuuGuuGAcccGuAuGAuTsT | A19283 | 806 | AUCAuACGGGUcAAcAAcATsT | AD-11943 |
| 384-402 | NP | A19284 | 807 | GuuuAccuGAGAGccuAcATsT | A19285 | 808 | UGuAGGCUCUCAGGuAAACTsT | AD-11944 |
| 400-418 | NP | A19286 | 809 | AcAAcAuGGAuAAAcGGGuTsT | A19287 | 810 | ACCCGUUuAUCcAUGUUGUTsT | AD-11945 |
| 1773-1791 | NP | A19288 | 811 | GGuGuuGuuGAcccGuAuGTsT | A19289 | 812 | cAuACGGGUcAAcAAcACCTsT | AD-11946 |
| 1964-1982 | NP | A19290 | 813 | GGAcGGAGcGAAAAAGGuTsT | A19291 | 814 | cACCUUUUUCGCUCCGUCCTsT | AD-11947 |
| 411-429 | NP | A19292 | 815 | AAAcGGGuGAGAGGuucAuTsT | A19293 | 816 | AUGAACCUCUcACCCGUUUTsT | AD-11948 |
| 1815-1833 | NP | A19294 | 817 | GAcuAcGAGGAuucGGcuGTsT | A19295 | 818 | cAGCCGAAUCCUCGuAGUCTsT | AD-11949 |
| 407-425 | NP | A19296 | 819 | GGAuAAAcGGGuGAGAGGuTsT | A19297 | 820 | ACCUCUCACCCGUUuAUCCTsT | AD-11950 |
| 2405-2423 | NP | A19298 | 821 | uuAucAccuAAuGAGuGAuTsT | A19299 | 822 | AUcACUcAUuAGGUGAuAATsT | AD-11951 |
| 409-427 | NP | A19300 | 823 | AuAAAcGGGuGAGAGGuucTsT | A19301 | 824 | GAACCUCUcACCCGUUuAUTsT | AD-11952 |
| 1811-1829 | NP | A19302 | 825 | UCCUGACUACGAGCAUUCGTsT | A19303 | 826 | CGAAUCCUCGuAGUcAGGATsT | AD-11953 |
| 408-426 | NP | A19304 | 827 | GAuAAAcGGGuGAGAGGuuTsT | A19305 | 828 | AACCUCUcACCCGUUuAUCTsT | AD-11954 |
| 1958-1976 | NP | A19306 | 829 | GAccuuGGACGGAGcGAAATsT | A19307 | 830 | UUUCGCUCCGUCcAAGGUCTsT | AD-11955 |
| 1973-1991 | NP | A19308 | 831 | GAAAAAGGuGccGGAGuuGTsT | A19309 | 832 | cAACUCCGGcACCUUUUUCTsT | AD-11956 |
| 1810-1828 | NP | A19310 | 833 | AuccuGAcuAcGAGGAuucTsT | A19311 | 834 | GAAUCCUCGuAGUcAGGAUTsT | AD-11957 |
| 1953-1971 | NP | A19312 | 835 | GAuccGAccUuGGACGGAGTsT | A19313 | 836 | CUCCGUCCAAGGUCGGAUCTsT | AD-11958 |
| 1692-1710 | NP | A19314 | 837 | CccGGGccGAucuAuGAuGTsT | A19315 | 838 | cAUcAuAGAUCGGCCCGGGTsT | AD-11959 |
| 197-215 | VP35 | A19316 | 839 | AccGGcAAAAuAccGcuAATsT | A19317 | 840 | UuAGCGGuAUUUUGCCGGUTsT | AD-11960 |
| 196-214 | VP35 | A19318 | 841 | GAcCGGcAAAAuAccGcuATsT | A19319 | 842 | uAGCGGuAUUUUGCCGGUCTsT | AD-11961 |
| 409-427 | VP35 | A19320 | 843 | AucAcuAGAAGGucGAGuATsT | A19321 | 844 | uACUCGACCUUCuAGUGAUTsT | AD-11962 |
| 476-494 | VP35 | A19322 | 845 | AuAucAucccuGAAucGcATsT | A19323 | 846 | UGCGAUUcAGGGAUGAuAUTsT | AD-11963 |
| 611-629 | VP35 | A19324 | 847 | ccAucAuuGuAcGAGGAuGTsT | A19325 | 848 | CAUCCUCGuAcAAUGAUGGTsT | AD-11964 |
| 645-663 | VP35 | A19326 | 849 | AAuuGAAAGAuccGAAcGGTsT | A19327 | 850 | CCGUUCGGAUCUUUcAAUUTsT | AD-11965 |

TABLE 2-continued

| position in target | Target | double overhang design sense strand | | | antisense strand | | | duplex name |
|---|---|---|---|---|---|---|---|---|
| | | name | Seq ID | sequence (5'-3') | name | Seq ID | sequence (5'-3') | |
| 726-744 | VP35 | A19328 | 851 | AGGAAAAuuucGGGcGAccTsT | A19329 | 852 | GGUCGCCCGAAAuuuUCCUTsT | AD-11966 |
| 1130-1148 | VP35 | A19330 | 853 | GuAAGcucAuuuuGcGAuGTsT | A19331 | 854 | cAUCGcAAAAUGAGCUuACTsT | AD-11967 |
| 729-747 | VP35 | A19332 | 855 | AAAAuuucGGGcGAccuuATsT | A19333 | 856 | uAAGGUCGCCCGAAAUUUUTsT | AD-11968 |
| 606-624 | VP35 | A19334 | 857 | cAGGcccAucAuuGuAcGATsT | A19335 | 858 | UCGuAcAAUGAUGGGCCUGTsT | AD-11969 |
| 256-274 | VP35 | A19336 | 859 | cccGAuAAccAuuAuuAGuTsT | A19337 | 860 | ACuAAuAAUGGUuAUCGGGTsT | AD-11970 |
| 478-496 | VP35 | A19338 | 861 | AucAucccuGAAucGcAGcTsT | A19339 | 862 | GCUGCGAUUcAGGGAUGAUTsT | AD-11971 |
| 724-742 | VP35 | A19340 | 863 | uGAGGAAAAuuucGGGcGATsT | A19341 | 864 | UCGCCCGAAAUUUUCCUcATsT | AD-11972 |
| 644-662 | VP35 | A19342 | 865 | AAAuuGAAAGAuccGAAcGTsT | A19343 | 866 | CGUUCGGAUCUUUcAAUUUTsT | AD-11973 |
| 1239-1257 | VP35 | A19344 | 867 | AuccuAAucAAuuGAuAAuTsT | A19345 | 868 | AUuAUcAAUUGAUuAGGAUTsT | AD-11974 |
| 1052-1070 | VP35 | A19346 | 869 | AucGAuAGAGGuuGGGucuTsT | A19347 | 870 | AGACCcAACCUCuAUCGAUTsT | AD-11975 |
| 429-447 | VP40 | A19348 | 871 | GcAAuuAuGcucGcAucuuTsT | A19349 | 872 | AAGAUGCGAGCAuAAUUGCTsT | AD-11976 |
| 1189-1207 | VP40 | A19350 | 873 | AAAAuGuAcuAAucGGGucTsT | A19351 | 874 | GACCCGAUuAGuAcAUUUUTsT | AD-11977 |
| 1190-1208 | VP40 | A19352 | 875 | AAAuGuAcuAAucGGGucATsT | A19353 | 876 | UGACCCGAUuAGuAcAUUUTsT | AD-11978 |
| 373-391 | VP40 | A19354 | 877 | GGuuGccAcucGGAAuuGcTsT | A19355 | 878 | GcAAUUCCGAGUGGcAACCTsT | AD-11979 |
| 439-457 | VP40 | A19356 | 879 | ucGcAucuuAuAcGAucAcTsT | A19357 | 880 | GUGAUCGuAuAAGAUGCGATsT | AD-11980 |
| 441-459 | VP40 | A19358 | 881 | GcAucuuAuAcGAucAcccTsT | A19359 | 882 | GGGUGAUCGuAuAAGAUGCTsT | AD-11981 |
| 1121-1139 | VP40 | A19360 | 883 | AuAGcAAcucAAucGAcuuTsT | A19361 | 884 | AAGUCGAUUGAGUUGCuAUTsT | AD-11982 |
| 1127-1145 | VP40 | A19362 | 885 | AcucAAucGAcuuuuAGGATsT | A19363 | 886 | UCCuAAAAGUCGAUUGAGUTsT | AD-11983 |
| 1193-1211 | VP40 | A19364 | 887 | uGuAcuAAucGGGucAAGGTsT | A19365 | 888 | CCUUGACCCGAUuAGuAcATsT | AD-11984 |
| 1298-1316 | VP40 | A19366 | 889 | ACAuGCAuAAGcGAuccAuTsT | A19367 | 890 | AUGGAUCGCUuAUGcAUGUTsT | AD-11985 |
| 1307-1325 | VP40 | A19368 | 891 | AGcGAuccAuAcuucGcccTsT | A19369 | 892 | GGGCGAAGuAUGGAUCGCUTsT | AD-11986 |
| 361-379 | VP40 | A19370 | 893 | AAAucccuAuuuGGuuGccTsT | A19371 | 894 | GGcAACcAAAuAGGGAUUUTsT | AD-11987 |
| 437-455 | VP40 | A19372 | 895 | GcucGcAucuuAuAcGAucTsT | A19373 | 896 | GAUCGuAuAAGAUGCGAGCTsT | AD-11988 |
| 857-875 | VP40 | A19374 | 897 | GAGuAcAuuGGGAucGAGTsT | A19375 | 898 | CUCGAUCCcAAUGAuACUCTsT | AD-11989 |
| 484-502 | VP40 | A19376 | 899 | ucGuuAGAGuGAAucGAcuTsT | A19377 | 900 | AGUCGAUUcACUCuAACGATsT | AD-11990 |
| 1845-1863 | GP | A19378 | 901 | GGAGcuGcGGAcAuAuAccTsT | A19379 | 902 | GGuAuAUGUCCGcAGCUCCTsT | AD-11991 |
| 254-272 | GP | A19380 | 903 | GAGAuuGAccAGcuAGucuTsT | A19381 | 904 | AGACuAGCUGGucAAUCUCTsT | AD-11992 |
| 461-479 | GP | A19382 | 905 | ccGGAcGGGAGcGAAuGcuTsT | A19383 | 906 | AGcAUUCGCUCCCGUCCGGTsT | AD-11993 |
| 466-484 | GP | A19384 | 907 | cGGGAGcGAAuGcuuAcccTsT | A19385 | 908 | GGGuAAGcAUUCGCUCCCGTsT | AD-11994 |
| 933-951 | GP | A19386 | 909 | uAAuuuGGAcAcuAGAuGcTsT | A19387 | 910 | GcAUCuAGUGUCcAAAUuATsT | AD-11995 |
| 1045-1363 | GP | A19388 | 911 | uuAucGcucAAcGAGAcAGTsT | A19389 | 912 | CUGUCUCGUUGAGCGAuAATsT | AD-11996 |
| 1100-1118 | GP | A19390 | 913 | GAAGAAucuccGAccGGGcTsT | A19391 | 914 | GCCCGGUCGGAGAuUCuUCTsT | AD-11997 |
| 1102-1120 | GP | A19392 | 915 | AGAAucuccGAccGGGccATsT | A19393 | 916 | UGGCCCGGUCGGAGAUUCUTsT | AD-11998 |
| 1191-1209 | GP | A19394 | 917 | AAcAACAuuGcCGucucAGTsT | A19395 | 918 | CUGAGACGGcAAUGUUGUUTsT | AD-11999 |
| 1203-1221 | GP | A19396 | 919 | GucucAGAAuucGAcAGAATsT | A19397 | 920 | uUCuGUCGAAuUCuGAGACTsT | AD-12000 |
| 1844-1862 | GP | A19398 | 921 | cGGAGcuGcGGAcAuAuAcTsT | A19399 | 922 | GuAuAUGUCCGcAGCUCCGTsT | AD-12001 |

TABLE 2-continued

| position in target | Target | double overhang design sense strand | | | antisense strand | | | duplex name |
|---|---|---|---|---|---|---|---|---|
| | | name | Seq ID | sequence (5'-3') | name | Seq ID | sequence (5'-3') | |
| 255-273 | GP | A19400 | 923 | AGAuuGAccAGcuAGucuGTsT | A19401 | 924 | cAGACuAGCUGGUcAAUCUTsT | AD-12002 |
| 1212-1230 | GP | A19402 | 925 | uucGAcAGAAGGucGAAGATsT | A19403 | 926 | UCUUCGACCUUCUGUCGAATsT | AD-12003 |
| 1706-1724 | GP | A19404 | 927 | GGAucccGuAcuuuGGAccTsT | A19405 | 928 | GGUCcAAAGuACGGGAUCCTsT | AD-12004 |
| 125-143 | GP | A19406 | 929 | cuuAGccuAcuccAAuuGcTsT | A19407 | 930 | GcAAUUGGAGuAGGCuAAGTsT | AD-12005 |
| 264-282 | GP | A19408 | 931 | AGcuAGucuGcAAGGAucATsT | A19409 | 932 | UGAUCCUUGcAGACuAGCUTsT | AD-12006 |
| 332-350 | GP | A19410 | 933 | AGcGGAGuAucuACuGAuATsT | A19411 | 934 | uAUcAGuAGAuACUCCGCUTsT | AD-12006 |
| 464-482 | GP | A19412 | 935 | GAcGGGAGcGAAuGcuuAcTsT | A19413 | 936 | GuAAGcAUUCGCUCCCGUCTsT | AD-12008 |
| 1210-1228 | GP | A19414 | 937 | AAuucGAcAGAAGGucGAATsT | A19415 | 938 | uUCGACCuUCuGUCGAAUUTsT | AD-12009 |
| 1213-1231 | GP | A19416 | 939 | ucGAcAGAAGGucGAAGAGTsT | A19417 | 940 | CUCuUCGACCuUCuGUCGATsT | AD-12010 |
| 1850-1868 | GP | A19418 | 941 | uGcGGAcAuAuAccAuAcuTsT | A19419 | 942 | AGuAUGGuAuAUGUCCGcATsT | AD-12011 |
| 124-142 | GP | A19420 | 943 | ucuuAGccuAcuccAAuuGTsT | A19421 | 944 | cAAUUGGAGuAGGCuAAGATsT | AD-12012 |
| 1044-1062 | GP | A19422 | 945 | uuuAucGcucAAcGAGAcATsT | A19423 | 946 | UGUCUCGUUGAGCGAuAAATsT | AD-12013 |
| 265-283 | GP | A19424 | 947 | GcuAGucuGcAAGGAucAuTsT | A19425 | 948 | AUGAUCCUUGcAGACuAGCTsT | AD-12014 |
| 361-379 | VP30 | A19426 | 949 | uAGAGucccuAcGGuuuucTsT | A19427 | 950 | GAAAACCGuAGGGACUCuATsT | AD-12015 |
| 324-342 | VP30 | A19428 | 951 | cAAcAGAcuAccGuAGuAGTsT | A19429 | 952 | CuACuACGGuAGUCUGUUGTsT | AD-12016 |
| 994-1012 | VP30 | A19430 | 953 | AGGccuAcGcuuAcuuGccTsT | A19431 | 954 | GGcAAGuAAGCGuAGGCCUTsT | AD-12017 |
| 248-266 | VP30 | A19432 | 955 | AGGAAuucAcGuGccGAccTsT | A19433 | 956 | GGUCGGcACGUGAAUUCCUTsT | AD-12018 |
| 491-509 | VP30 | A19434 | 957 | cuuGAAAGCcuAAccGAccTsT | A19435 | 958 | GGUCGGuuAGGCUUUcAAGTsT | AD-12019 |
| 322-340 | VP30 | A19436 | 959 | AAcAAcAGAcuAccGuAGuTsT | A19437 | 960 | ACuACGGuAGUCUGUUGUUTsT | AD-12020 |
| 323-341 | VP30 | A19438 | 961 | AcAAcAGAcuAccGuAGuATsT | A19439 | 962 | uACuACGGuAGUCUGUUGUTsT | AD-12021 |
| 517-535 | VP30 | A19440 | 963 | ccuAcuucuuAuAGcAcGGTsT | A19441 | 964 | CCGUGCuAuAAGAAGuAGGTsT | AD-12022 |
| 295-313 | VP30 | A19442 | 965 | GAcAAGAuccAuuucccGGTsT | A19443 | 966 | CCGGGAAAuGGAUCuuGUCTsT | AD-12023 |
| 229-247 | VP30 | A19444 | 967 | ucGuGAGcGCGGGAGAucATsT | A19445 | 968 | UGAUCUCCCGCGCUcACGATsT | AD-12024 |
| 251-269 | VP30 | A19446 | 969 | AAuucAcGuGccGAccAGcTsT | A19447 | 970 | GCUGGUCGGcACGUGAAUUTsT | AD-12025 |
| 340-358 | VP30 | A19448 | 971 | uAGucGAAGuAcuucGcAATsT | A19449 | 972 | UUGCGAAGuACUUCGACuATsT | AD-12026 |
| 1350-1368 | VP30 | A19450 | 973 | ucccuAGAAGcGuuGAAucTsT | A19451 | 974 | GAUUcAACGCUUCuAGGGATsT | AD-12027 |
| 1057-1075 | VP24 | A19452 | 975 | uAuGGGuuAucuuGcGAGTsT | A19453 | 976 | CUCGAcAAGAuAACCcAuATsT | AD-12028 |
| 878-896 | VP24 | A19454 | 977 | AAcAuGAGAAcucAAcGAGTsT | A19455 | 978 | CUCGUUGAGUUCUcAUGUUTsT | AD-12029 |
| 1056-1074 | VP24 | A19456 | 979 | AuAuGGGuuAucuuGucGATsT | A19457 | 980 | UCGAcAAGAuAACCcAuAUTsT | AD-12030 |
| 1137-1155 | VP24 | A19458 | 981 | uAcuAcAuGAAucGAcAcuTsT | A19459 | 982 | AGUGUCGAUUcAUGuAGuATsT | AD-12031 |
| 1099-1117 | VP24 | A19460 | 983 | GAuGGAuAuAcGAcAcCcuTsT | A19461 | 984 | AGGGUGUCGuAuAUCcAUCTsT | AD-12032 |
| 1591-1609 | VP24 | A19462 | 985 | AGCcCAAAuuAAcAcGGuATsT | A19463 | 986 | uACCGUGUuAAUUUGGGCUTsT | AD-12033 |
| 1094-1112 | VP24 | A19464 | 987 | ucuGcGAuGGAuAuAcGAcTsT | A19465 | 988 | GUCGuAuAUCcAUCGcAGATsT | AD-12034 |
| 1135-1153 | VP24 | A19466 | 989 | cuuAcuAcAuGAAucGAcATsT | A19467 | 990 | UGUCGAUUcAUGuAGuAAGTsT | AD-12035 |
| 152-170 | VP24 | A19468 | 991 | cuAGGcuAGGGuuuAuAGuTsT | A19469 | 992 | ACuAuAAACCCuAGCCuAGTsT | AD-12036 |
| 624-642 | VP24 | A19470 | 993 | AccAAAAGGGuAuuAcccuTsT | A19471 | 994 | AGGGuAAuACCCUUUUGGUTsT | AD-12037 |

TABLE 3

| duplex name | Ebola Zaire GFP assay % reduction | | | Ebola Zaire plaque % reduction vs no si TABLE 3-continued

| duplex name | Ebola Zaire GFP assay % reduction | | | Ebola Zaire plaque % reduction vs no siRNA | Ebola Sudan IF assay % reduction | | | Ebola Sudan plaque % reduction vs no siRNA |
|---|---|---|---|---|---|---|---|---|
| | 100 nM | 10 nM | 1 nM | | 100 nM | 10 nM | 1 nM | |
| AD-11615 | −5.9 | 22.3 | −0.9 | | −24.8 | −16.9 | −21.2 | |
| AD-11616 | 2.3 | 5.5 | 11.0 | | −10.4 | −7.6 | 26.4 | |
| AD-11617 | 14.3 | 5.3 | −1.9 | −617.15 | 39.8 | 62.5 | 91.5 | 14.55 |
| AD-11618 | −2.5 | −4.3 | −1.2 | | −11.0 | −26.8 | −28.6 | |
| AD-11619 | −8.3 | −37.8 | −30.2 | | −33.9 | −43.8 | −23.9 | |
| AD-11620 | 11.0 | −19.2 | −37.5 | | −30.5 | −12.0 | 0.7 | |
| AD-11621 | −29.1 | −4.5 | 4.7 | −255.66 | 60.9 | 64.7 | 78.8 | 74.06 |
| AD-11622 | 11.9 | 15.0 | 4.2 | | 9.8 | −29.1 | −15.8 | |
| AD-11623 | 7.7 | −17.8 | −24.6 | | −27.3 | −48.1 | −19.4 | |
| AD-11624 | −16.3 | −36.6 | −45.8 | | −36.1 | −17.2 | −8.3 | |
| AD-11625 | 45.0 | 11.0 | 0.3 | 37.98 | 19.5 | 48.2 | 43.1 | −23.73 |
| AD-11626 | −3.6 | 13.2 | 11.9 | | −25.4 | −81.4 | −80.3 | |
| AD-11627 | 34.1 | 24.7 | 21.1 | 48.69 | −46.8 | −73.0 | −54.8 | 12.71 |
| AD-11628 | −8.9 | −1.4 | −13.8 | 9.60 | −9.5 | 6.1 | 35.2 | 59.80 |
| AD-11629 | 22.9 | 23.0 | 11.8 | −73.11 | 65.3 | 71.2 | 75.1 | 3.39 |
| AD-11630 | 12.2 | 19.0 | −2.0 | | −99.9 | −123.8 | −85.0 | |
| AD-11631 | −10.4 | −15.2 | −18.3 | | −127.0 | −87.2 | −59.2 | |
| AD-11632 | −50.7 | −49.9 | −49.4 | −128.91 | −32.4 | 1.3 | 29.8 | 51.76 |
| AD-11633 | −39.4 | −10.2 | 1.8 | −19.31 | 20.6 | 42.9 | 57.4 | 49.57 |
| AD-11634 | 2.2 | 12.3 | −14.1 | | −55.8 | −129.3 | −136.9 | |
| AD-11635 | −44.3 | −46.0 | −29.5 | | −60.2 | −89.0 | −66.2 | |
| AD-11636 | −48.8 | −44.7 | −41.1 | | −35.4 | −17.4 | 7.3 | |
| AD-11637 | −36.8 | −27.2 | −17.3 | 59.55 | 34.3 | 33.8 | 52.8 | 80.40 |
| AD-11638 | −8.4 | 8.5 | −3.9 | | −9.4 | 12.4 | 28.9 | |
| AD-11639 | −47.6 | −1.7 | 36.0 | 23.31 | 2.9 | 20.2 | 12.6 | −97.46 |
| AD-11640 | 69.4 | 39.4 | 34.6 | 75.14 | 66.0 | 71.5 | 82.5 | 49.15 |
| AD-11641 | 42.6 | 15.2 | 15.9 | 65.14 | 73.1 | 81.9 | 87.7 | 96.50 |
| AD-11642 | 24.8 | 21.4 | 32.7 | −42.93 | 89.8 | 87.4 | 87.4 | 4.03 |
| AD-11643 | 37.7 | 53.8 | 52.7 | 89.14 | 94.3 | 94.2 | 97.5 | −22.03 |
| AD-11644 | 54.1 | 17.7 | 5.5 | 94.29 | 26.7 | 38.5 | 51.2 | 31.78 |
| AD-11645 | 5.9 | 2.5 | −2.5 | 51.97 | 64.7 | 68.1 | 80.1 | 93.34 |
| AD-11646 | −1.7 | 2.1 | 7.9 | 59.55 | 72.6 | 76.8 | 79.0 | 92.72 |
| AD-11647 | 8.4 | 8.8 | 37.5 | 57.28 | 75.6 | 81.7 | 93.7 | 74.71 |
| AD-11648 | 56.9 | 19.2 | 8.1 | 66.10 | −15.4 | −9.9 | 13.0 | 71.19 |
| AD-11649 | −3.3 | −6.9 | −3.5 | 65.47 | 36.0 | 54.2 | 64.9 | 82.84 |
| AD-11650 | 1.9 | −2.5 | −1.5 | 17.28 | 58.7 | 65.3 | 59.6 | 2.31 |
| AD-11651 | 6.7 | 9.4 | 30.9 | 65.70 | 70.3 | 87.1 | 91.2 | 83.96 |
| AD-11652 | 55.8 | 27.7 | 10.3 | | −56.8 | 59.6 | 68.4 | 33.90 |
| AD-11653 | 12.4 | 13.8 | 10.9 | 86.84 | 66.4 | 70.4 | 75.8 | 2.02 |
| AD-11654 | 13.8 | 7.2 | 10.7 | | 76.1 | 73.8 | 73.8 | −123.92 |
| AD-11655 | 9.1 | 14.6 | 40.5 | −7.01 | 82.4 | 83.9 | 92.6 | −146.11 |
| AD-11656 | 39.1 | 9.6 | −1.0 | 81.71 | −21.9 | 30.7 | 19.0 | 20.34 |
| AD-11657 | −1.1 | 1.1 | 0.2 | | −3.1 | 20.7 | 48.9 | |
| AD-11658 | 7.3 | 0.9 | 1.5 | 86.84 | 55.5 | 50.8 | 41.3 | 93.52 |
| AD-11659 | 2.9 | 4.1 | 28.0 | 78.79 | 46.4 | 51.1 | 66.6 | 79.47 |
| AD-11660 | 23.8 | 13.0 | 0.9 | 80.57 | 11.0 | 20.8 | −57.0 | 90.51 |
| AD-11661 | −6.4 | −8.0 | −6.1 | | −37.1 | −16.9 | 19.1 | |
| AD-11662 | −1.6 | −7.9 | −7.9 | | 10.9 | 10.7 | 27.7 | |
| AD-11663 | 1.6 | 5.6 | 28.1 | | 25.4 | 20.4 | 30.8 | |
| AD-11664 | 11.9 | 7.6 | 3.9 | 50.16 | 54.4 | 63.1 | 66.8 | 77.95 |
| AD-11665 | 5.1 | 1.2 | 0.2 | 15.10 | 52.7 | 65.2 | 62.3 | −13.26 |
| AD-11666 | 0.0 | −3.5 | 5.3 | 5.72 | 67.9 | 80.3 | 80.3 | 79.54 |
| AD-11667 | 3.7 | 2.9 | 8.0 | 47.73 | 83.6 | 80.4 | 90.6 | 84.70 |
| AD-11668 | 16.3 | −0.3 | −1.3 | | −91.6 | −4.4 | 2.8 | |
| AD-11669 | −1.0 | 3.8 | 0.3 | | 3.4 | 33.5 | 43.3 | |
| AD-11670 | −0.1 | −4.6 | −2.6 | 35.28 | 42.7 | 43.6 | 62.6 | −5.48 |
| AD-11671 | 0.1 | 1.1 | 16.0 | 80.58 | 61.0 | 65.1 | 72.7 | 13.54 |
| AD-11672 | 8.2 | −0.1 | −2.2 | | −69.9 | 25.3 | −57.8 | |
| AD-11673 | 1.7 | 0.9 | 3.2 | | −46.1 | −22.7 | 1.5 | |
| AD-11674 | −4.2 | −3.0 | −6.0 | | 34.4 | 14.8 | 32.2 | |
| AD-11675 | −0.6 | 0.6 | 18.4 | | 11.1 | 45.1 | 59.7 | |
| AD-11676 | 22.1 | 11.5 | 7.7 | 78.86 | 75.7 | 86.4 | 78.6 | 16.95 |
| AD-11677 | 5.6 | −3.1 | 3.2 | | 86.1 | 78.0 | 87.1 | 1.27 |
| AD-11678 | −2.3 | −7.8 | 5.0 | 87.06 | 86.4 | 86.6 | 86.6 | −141.35 |
| AD-11679 | 5.6 | 7.3 | 34.4 | 28.26 | 88.3 | 88.6 | 90.9 | −79.25 |
| AD-11680 | 30.4 | 7.9 | −0.5 | 75.62 | −38.9 | 13.4 | −88.3 | 72.03 |
| AD-11681 | −3.7 | −10.1 | −0.2 | | 14.4 | 25.0 | 24.2 | |
| AD-11682 | −10.0 | −11.0 | −7.7 | | −39.9 | 53.8 | 57.2 | |
| AD-11683 | −6.4 | 6.6 | 32.3 | 92.99 | 59.6 | 53.3 | 48.2 | 57.85 |
| AD-11684 | 31.5 | 14.4 | 2.9 | 33.26 | −156.0 | −119.6 | −198.2 | 87.80 |
| AD-11685 | 0.0 | −6.5 | −9.5 | −6.15 | −43.0 | −107.3 | −93.7 | −20.61 |
| AD-11686 | −12.0 | −7.9 | −4.7 | 88.12 | −134.6 | −69.2 | −151.8 | 43.11 |
| AD-11687 | −4.8 | 6.3 | 29.0 | | −77.4 | −41.4 | −79.0 | |

TABLE 3-continued

| duplex name | Ebola Zaire GFP assay % reduction | | | Ebola Zaire plaque % reduction vs | Ebola Sudan IF assay % reduction | | | Ebola Sudan plaque % reduction vs |
|---|---|---|---|---|---|---|---|---|
| | 100 nM | 10 nM | 1 nM | no siRNA | 100 nM | 10 nM | 1 nM | no siRNA |
| AD-11688 | 40.0 | 28.5 | 26.7 | −15.66 | 73.4 | 79.8 | 88.0 | 66.95 |
| AD-11689 | 34.4 | 27.1 | 32.4 | 57.33 | 83.4 | 74.8 | 86.5 | 85.59 |
| AD-11690 | 24.0 | 30.2 | 42.1 | 71.71 | 82.5 | 89.4 | 89.4 | 83.05 |
| AD-11691 | 47.9 | 44.1 | 55.3 | 87.43 | 92.0 | 93.9 | 97.0 | 70.96 |
| AD-11694 | 44.3 | 8.5 | 5.7 | | 2.1 | 4.8 | 13.6 | |
| AD-11695 | 1.5 | 0.5 | −5.3 | | 42.1 | 36.7 | 46.0 | |
| AD-11696 | 5.1 | 4.8 | 10.8 | | 49.2 | 56.9 | 76.3 | |
| AD-11698 | 18.4 | 20.4 | 45.5 | 59.09 | 69.5 | 79.5 | 82.0 | 54.66 |
| AD-11700 | 30.4 | 8.5 | −2.1 | 84.00 | −151.2 | −108.0 | −67.5 | 4.52 |
| AD-11704 | −7.2 | −6.1 | −9.9 | | −37.2 | −56.5 | −32.4 | |
| AD-11705 | −2.9 | −2.4 | −4.7 | | −7.3 | 0.9 | −14.8 | |
| AD-11706 | 8.5 | 21.1 | 99.9 | | 21.5 | −8.9 | 33.9 | |
| AD-11707 | 41.8 | 25.9 | 21.9 | 90.69 | 79.3 | 84.2 | 85.1 | 63.14 |
| AD-11708 | 27.2 | 27.4 | 28.1 | 83.92 | 80.0 | 81.1 | 83.7 | 24.58 |
| AD-11710 | 31.0 | 37.7 | 43.0 | 77.54 | 86.9 | 89.6 | 89.6 | 99.70 |
| AD-11711 | 33.8 | 36.5 | 48.2 | 73.43 | 91.1 | 89.8 | 93.9 | −34.75 |
| AD-11712 | 81.1 | 20.2 | 8.0 | 79.71 | 22.6 | −4.3 | 27.5 | −13.56 |
| AD-11713 | −8.6 | −4.0 | −2.1 | | 39.1 | 39.1 | 51.8 | |
| AD-11714 | −8.7 | −8.3 | −4.3 | 63.27 | 45.0 | 66.1 | 74.5 | 39.48 |
| AD-11715 | 0.8 | 14.9 | 40.7 | −92.23 | 79.0 | 82.0 | 86.9 | 1.15 |
| AD-11716 | 32.4 | 8.3 | 1.8 | 83.05 | −46.0 | −51.4 | −11.3 | −577.97 |
| AD-11717 | 2.2 | −0.5 | −0.6 | | −1.5 | −13.0 | −14.3 | |
| AD-11718 | −8.1 | −11.9 | −19.8 | | 2.4 | 18.8 | 29.2 | |
| AD-11719 | 4.2 | 11.6 | 33.8 | 57.93 | 55.3 | 56.6 | 74.0 | −2.02 |
| AD-11720 | 29.8 | 17.3 | 10.4 | 77.05 | 86.4 | 91.8 | 95.6 | −373.73 |
| AD-11721 | 14.6 | 13.7 | 12.4 | 82.56 | 90.8 | 91.1 | 95.1 | −31.70 |
| AD-11722 | 17.0 | 15.1 | 23.7 | 82.96 | 94.1 | 91.7 | 91.7 | −112.39 |
| AD-11723 | 16.0 | 13.5 | 30.5 | 90.99 | 94.1 | 95.5 | 95.7 | −55.62 |
| AD-11724 | 33.9 | 10.4 | 5.1 | 99.98 | 63.2 | 73.2 | 73.7 | −1.27 |
| AD-11725 | 6.4 | −2.0 | 0.0 | 93.62 | 85.5 | 92.4 | 89.5 | −172.62 |
| AD-11726 | 2.4 | 0.2 | 0.2 | 58.58 | 90.3 | 91.9 | 94.4 | −2.54 |
| AD-11727 | −1.0 | 2.8 | 20.2 | 4.72 | 93.9 | 94.5 | 98.3 | 49.86 |
| AD-11728 | 30.7 | 12.9 | 4.0 | 73.43 | 26.9 | 27.5 | 41.0 | 30.51 |
| AD-11729 | 5.1 | 1.5 | −4.3 | 26.86 | 51.9 | 65.4 | 58.9 | −20.46 |
| AD-11730 | 2.6 | 1.3 | 0.8 | 24.70 | 60.2 | 67.7 | 71.6 | 52.02 |
| AD-11731 | 4.9 | 3.3 | 24.1 | 79.94 | 66.8 | 67.3 | 89.0 | 96.16 |
| AD-11732 | 33.6 | 9.3 | 6.0 | 63.43 | 63.0 | 79.9 | 87.5 | 70.34 |
| AD-11733 | 2.2 | 2.8 | −0.7 | 75.57 | 84.2 | 89.7 | 85.1 | −9.51 |
| AD-11734 | 8.6 | 6.7 | 10.8 | 90.52 | 90.8 | 90.6 | 90.6 | −119.16 |
| AD-11735 | 6.9 | 9.3 | 31.4 | −22.87 | 90.8 | 88.5 | 94.5 | −77.23 |
| AD-11736 | 31.5 | 9.9 | 3.0 | 21.14 | 29.9 | 39.5 | 45.3 | −611.86 |
| AD-11737 | −8.0 | −3.4 | −1.7 | −183.17 | 78.3 | 88.4 | 82.5 | 14.41 |
| AD-11738 | −0.2 | 1.5 | −4.7 | −102.05 | 85.3 | 86.4 | 80.4 | 10.52 |
| AD-11739 | 7.4 | 3.8 | 21.5 | 52.75 | 53.8 | 55.2 | 83.5 | 89.27 |
| AD-11740 | 30.0 | 11.7 | −0.4 | 53.43 | −87.3 | −64.8 | 12.1 | 38.98 |
| AD-11741 | −3.5 | −6.1 | −2.9 | 42.39 | 27.2 | 47.7 | 36.1 | −32.56 |
| AD-11742 | −1.0 | −1.9 | −6.0 | 40.35 | 49.9 | 56.9 | 20.5 | 12.25 |
| AD-11743 | 0.1 | 6.6 | 26.9 | 37.35 | 46.3 | 24.7 | 71.2 | 26.08 |
| AD-11744 | 40.5 | 24.2 | 21.0 | 75.24 | 42.9 | 52.0 | 90.3 | 32.20 |
| AD-11745 | 26.3 | 23.1 | 23.3 | 55.43 | 64.3 | 74.1 | 84.5 | 54.24 |
| AD-11746 | 7.2 | 0.9 | −4.8 | 89.82 | 42.3 | 74.8 | 8.6 | 33.49 |
| AD-11747 | 1.6 | −3.5 | −5.4 | | 54.9 | 5.8 | 25.4 | |
| AD-11748 | −4.3 | 0.5 | 0.9 | | 30.3 | 10.9 | 10.9 | |
| AD-11749 | 8.4 | 3.9 | 1.0 | | 41.4 | −3.7 | 54.3 | |
| AD-11750 | 4.8 | 2.1 | 0.0 | | 44.9 | 30.4 | 71.5 | |
| AD-11751 | 3.3 | 0.6 | −2.2 | | 34.3 | −18.6 | 29.4 | |
| AD-11752 | 17.7 | 6.5 | 3.2 | −27.63 | 19.8 | 19.6 | −0.1 | 61.08 |
| AD-11753 | 1.7 | 1.2 | 0.9 | | −62.5 | −40.7 | 28.2 | |
| AD-11754 | 3.7 | 1.8 | 0.7 | | 69.9 | 91.1 | 44.9 | |
| AD-11755 | 37.7 | 26.6 | 10.8 | −58.93 | 10.1 | 0.6 | 28.8 | 47.05 |
| AD-11756 | −1.0 | −0.6 | 0.3 | | −39.8 | −16.7 | −5.7 | |
| AD-11757 | 0.2 | 0.0 | 1.8 | | −46.4 | −12.7 | −2.7 | |
| AD-11758 | 18.9 | 11.7 | 7.5 | 21.83 | 27.3 | 12.4 | −9.8 | 70.02 |
| AD-11759 | 26.1 | 15.1 | 18.8 | −595.93 | −6.9 | −3.8 | −22.6 | 55.98 |
| AD-11760 | 21.9 | 19.5 | 6.0 | 11.60 | −61.2 | 6.6 | 6.6 | 22.49 |
| AD-11761 | 18.1 | 8.6 | 6.4 | −67.30 | 39.7 | 43.4 | 58.0 | 71.77 |
| AD-11762 | 15.4 | 9.7 | 4.2 | −335.24 | 38.7 | −86.0 | 12.4 | 73.68 |
| AD-11763 | 6.8 | 7.3 | 3.7 | | −3.6 | −0.7 | 8.7 | |
| AD-11764 | 5.1 | 5.7 | 0.9 | | −34.9 | 28.7 | 18.2 | |
| AD-11765 | 14.8 | 8.0 | 4.3 | 5.98 | 32.1 | 27.3 | 58.4 | 76.08 |
| AD-11766 | 2.9 | 3.5 | 3.9 | | 13.4 | −6.1 | −68.1 | |
| AD-11767 | 24.1 | 15.1 | 5.5 | 7.18 | 32.9 | −27.7 | 0.2 | 9.57 |
| AD-11768 | 19.2 | 16.5 | 4.3 | 30.34 | −92.5 | −3.0 | 4.0 | 55.98 |

TABLE 3-continued

| duplex name | Ebola Zaire GFP assay % reduction | | | Ebola Zaire plaque % reduction vs no siRNA | Ebola Sudan IF assay % reduction | | | Ebola Sudan plaque % reduction vs no siRNA |
|---|---|---|---|---|---|---|---|---|
| | 100 nM | 10 nM | 1 nM | | 100 nM | 10 nM | 1 nM | |
| AD-11769 | 5.6 | 2.3 | 2.6 | | 6.7 | 25.7 | 43.9 | |
| AD-11770 | 14.0 | 7.2 | 2.2 | −16.41 | 19.1 | 34.2 | 35.3 | 49.60 |
| AD-11771 | 2.8 | 2.1 | 1.3 | | 37.7 | 19.1 | 15.6 | |
| AD-11772 | 4.0 | 2.2 | 2.6 | | 70.0 | 52.3 | 52.3 | |
| AD-11773 | 1.3 | −0.6 | −0.7 | | 52.0 | 65.8 | 65.4 | |
| AD-11774 | 2.0 | 1.5 | 0.5 | | 73.1 | −18.3 | 6.5 | |
| AD-11775 | 2.3 | 0.3 | −0.2 | | 57.8 | 49.1 | 5.5 | |
| AD-11776 | 2.7 | 0.4 | 1.6 | | 59.6 | 48.4 | 41.0 | |
| AD-11777 | 3.6 | 1.3 | 0.0 | | 10.4 | 47.2 | 53.8 | |
| AD-11778 | 0.9 | −0.9 | −0.8 | | 40.4 | −13.5 | −17.7 | |
| AD-11779 | 6.3 | 1.7 | −0.5 | | 42.1 | 2.9 | −6.9 | |
| AD-11780 | 5.8 | 0.1 | 0.1 | | 29.5 | −17.6 | 20.3 | |
| AD-11781 | 2.3 | 1.0 | −0.2 | | 8.8 | 33.5 | 39.1 | |
| AD-11782 | −1.7 | −4.0 | −4.1 | | 48.1 | 44.5 | 56.1 | |
| AD-11783 | −3.5 | −2.1 | −1.5 | | 34.8 | 16.7 | 44.2 | |
| AD-11784 | 5.7 | 3.7 | −1.0 | | 50.4 | 59.1 | 59.1 | |
| AD-11785 | 2.8 | 1.0 | 1.5 | | 75.3 | 88.0 | 81.7 | |
| AD-11786 | 14.9 | 6.5 | −2.9 | 97.46 | −7.0 | −34.8 | −6.5 | 66.19 |
| AD-11787 | −0.3 | 0.0 | −2.9 | | 9.0 | −8.6 | 18.2 | |
| AD-11788 | −0.1 | 0.5 | 1.3 | | 23.5 | 11.8 | 55.0 | |
| AD-11789 | 5.1 | 5.7 | 3.1 | | 57.8 | 45.6 | 62.5 | |
| AD-11790 | 5.7 | 0.0 | −4.0 | | 18.8 | −12.3 | −1.9 | |
| AD-11791 | −1.5 | −2.6 | −4.6 | | 42.1 | −27.4 | 10.4 | |
| AD-11792 | −0.9 | 1.8 | 1.5 | | 27.1 | 30.8 | 24.6 | |
| AD-11793 | 2.2 | 3.7 | 4.4 | | 6.7 | 34.8 | 44.3 | |
| AD-11794 | 0.4 | −0.5 | −1.6 | | 59.5 | 81.9 | 69.3 | |
| AD-11795 | −1.9 | −0.8 | 0.1 | | 78.7 | 94.4 | 87.7 | |
| AD-11796 | 5.0 | 1.8 | 0.8 | | 89.6 | 71.8 | 71.8 | |
| AD-11797 | 0.6 | 0.8 | 1.3 | | 92.1 | 87.0 | 83.7 | |
| AD-11798 | −0.2 | −0.2 | −1.8 | | 67.4 | 69.7 | 45.4 | |
| AD-11799 | −2.1 | −1.9 | −1.3 | | −49.1 | −5.6 | 72.9 | |
| AD-11800 | 1.3 | −1.0 | −0.4 | | 64.1 | 58.5 | 60.6 | |
| AD-11801 | 0.1 | 0.1 | 0.8 | | 23.7 | 35.3 | 54.5 | |
| AD-11802 | 4.8 | 0.8 | −0.4 | | −115.9 | −81.0 | −113.4 | |
| AD-11803 | 3.7 | 1.3 | −2.1 | | 10.5 | 22.6 | 16.3 | |
| AD-11804 | −2.0 | −1.1 | 0.0 | | 16.0 | 19.8 | 36.1 | |
| AD-11805 | −0.5 | 0.2 | −0.4 | | −6.9 | 6.5 | 51.6 | |
| AD-11806 | −11.1 | −16.4 | −13.0 | | 79.5 | 70.3 | 29.3 | |
| AD-11807 | 13.3 | −13.2 | −11.2 | −78.63 | 65.7 | 20.0 | 50.5 | −58.37 |
| AD-11808 | −6.3 | −9.0 | 9.4 | | 27.5 | 30.6 | 30.6 | |
| AD-11809 | −0.2 | −11.7 | −11.7 | | 44.7 | 61.3 | 73.0 | |
| AD-11810 | −15.2 | −17.1 | −17.8 | | 80.1 | 81.6 | 81.7 | |
| AD-11811 | −9.7 | −12.1 | −11.2 | | 40.4 | 38.0 | 23.7 | |
| AD-11812 | −8.1 | −12.5 | −15.0 | | 21.4 | 12.4 | 22.7 | |
| AD-11813 | 29.3 | −14.5 | −6.8 | −258.78 | 31.4 | 32.0 | 43.9 | −423.13 |
| AD-11814 | −19.9 | −18.8 | −8.1 | | 49.2 | 15.1 | 55.1 | |
| AD-11815 | −12.8 | −13.4 | −14.9 | | 62.5 | 29.3 | 36.0 | |
| AD-11816 | −14.5 | −15.2 | −14.6 | | 13.0 | −11.9 | 46.2 | |
| AD-11817 | −15.4 | −15.2 | −11.8 | | 43.3 | 38.2 | 42.0 | |
| AD-11818 | 9.5 | −1.9 | −6.6 | −176.59 | 69.0 | 43.6 | 35.2 | 39.23 |
| AD-11819 | −3.5 | −1.4 | −1.9 | | 75.0 | 50.7 | 31.2 | |
| AD-11820 | 7.6 | 4.4 | −2.0 | −327.48 | 58.5 | 50.6 | 50.6 | 29.19 |
| AD-11821 | 1.3 | −0.5 | 1.6 | | 42.4 | 26.4 | 49.4 | |
| AD-11822 | 7.7 | −4.1 | −4.2 | | 82.6 | 70.2 | 71.9 | |
| AD-11823 | −1.5 | −2.3 | −0.4 | | 63.9 | 58.8 | 37.4 | |
| AD-11824 | 3.2 | 1.7 | −2.7 | | 33.5 | 13.3 | 37.3 | |
| AD-11825 | 0.1 | −0.9 | 0.7 | | 53.6 | 42.2 | 44.8 | |
| AD-11826 | 3.4 | −6.1 | −3.8 | | 52.8 | 35.7 | 39.9 | |
| AD-11827 | −4.2 | −2.6 | −1.1 | | 54.5 | 26.3 | 15.2 | |
| AD-11828 | 0.8 | −1.3 | −1.4 | | 9.3 | −4.3 | 19.5 | |
| AD-11829 | 2.0 | −1.6 | 1.1 | | 32.2 | 16.0 | 32.0 | |
| AD-11830 | −4.3 | −7.5 | −8.0 | | 44.5 | 48.3 | 75.6 | |
| AD-11831 | −6.4 | −5.2 | −4.1 | | 39.3 | 56.5 | 67.3 | |
| AD-11832 | −3.2 | −2.5 | −3.0 | | 61.0 | 76.2 | 76.2 | |
| AD-11833 | −1.4 | −2.5 | −1.2 | | 80.6 | 87.2 | 91.0 | |
| AD-11834 | 18.8 | 2.8 | −7.7 | −260.69 | 7.3 | −11.5 | 24.5 | 25.84 |
| AD-11835 | −2.0 | −0.2 | −4.6 | | 52.7 | 59.4 | 61.0 | |
| AD-11836 | 3.3 | 0.7 | −1.9 | | 70.7 | 76.0 | 80.0 | |
| AD-11837 | 0.3 | −2.3 | −0.7 | | 84.6 | 70.1 | 80.8 | |
| AD-11838 | −7.4 | −7.1 | −8.8 | | −13.5 | 9.5 | 8.9 | |
| AD-11839 | −5.6 | −2.9 | −2.2 | | −0.7 | 45.3 | 48.4 | |
| AD-11840 | −1.7 | 1.3 | −0.2 | | 85.7 | 61.6 | 59.6 | |
| AD-11841 | −3.8 | −1.8 | −2.3 | | 60.7 | 52.5 | 50.8 | |

TABLE 3-continued

| duplex name | Ebola Zaire GFP assay % reduction | | | Ebola Zaire plaque % reduction vs no siRNA | Ebola Sudan IF assay % reduction | | | Ebola Sudan plaque % reduction vs no siRNA |
|---|---|---|---|---|---|---|---|---|
| | 100 nM | 10 nM | 1 nM | | 100 nM | 10 nM | 1 nM | |
| AD-11842 | 14.4 | 7.7 | 0.8 | 35.57 | −145.5 | −117.2 | −46.4 | 42.11 |
| AD-11843 | ND | ND | ND | | −68.1 | −87.6 | −36.1 | |
| AD-11844 | 0.0 | 1.4 | −0.5 | | −72.1 | −80.2 | −80.2 | |
| AD-11845 | 3.9 | 2.0 | 1.1 | | −34.1 | −60.1 | −13.9 | |
| AD-11846 | 27.5 | 20.0 | −7.1 | 25.19 | −69.7 | −62.0 | −63.7 | 13.40 |
| AD-11847 | −5.9 | −4.8 | −6.2 | | −93.2 | −61.3 | −57.4 | |
| AD-11848 | −1.3 | 0.6 | −1.7 | | −89.3 | −76.1 | −18.3 | |
| AD-11849 | −1.0 | −1.4 | 50.6 | | −0.9 | 12.6 | 18.7 | |
| AD-11850 | −4.1 | 2.9 | −6.3 | | −15.1 | −3.7 | −34.5 | |
| AD-11851 | −5.0 | −4.6 | −2.2 | | −13.3 | −10.3 | −15.2 | |
| AD-11852 | −0.4 | −0.6 | −0.6 | | 7.7 | 11.6 | 10.2 | |
| AD-11853 | 1.6 | −0.6 | −0.8 | | 24.9 | 28.1 | 36.7 | |
| AD-11854 | −0.6 | −1.3 | −1.8 | | 50.9 | 35.6 | 21.2 | |
| AD-11855 | 5.0 | 3.4 | 1.6 | | 47.8 | 24.7 | 28.6 | |
| AD-11856 | 2.3 | 0.9 | −0.6 | | 60.4 | 36.7 | 36.7 | |
| AD-11857 | 3.4 | 0.7 | 0.1 | | 23.1 | 37.0 | 57.6 | |
| AD-11858 | −2.3 | −2.5 | −2.7 | | 59.8 | 78.3 | 41.7 | |
| AD-11859 | 0.6 | 2.0 | −1.0 | | 64.0 | 33.3 | 40.7 | |
| AD-11860 | 11.4 | 6.4 | 0.1 | 32.44 | 40.2 | −5.8 | 34.3 | 54.70 |
| AD-11861 | 3.2 | 1.7 | −0.4 | | −6.3 | −30.9 | 26.8 | |
| AD-11862 | 15.3 | 3.2 | −3.1 | −55.53 | 37.3 | 6.8 | 51.0 | 51.20 |
| AD-11863 | 8.7 | 8.8 | 4.1 | −77.56 | 26.0 | 17.7 | 37.8 | 80.86 |
| AD-11864 | 8.9 | 3.5 | −1.4 | −179.90 | 40.7 | 27.9 | −8.9 | 69.38 |
| AD-11865 | 4.3 | 0.2 | 0.1 | | 0.3 | 8.6 | 14.9 | |
| AD-11870 | 4.5 | 5.7 | 1.9 | | 60.1 | 43.2 | 68.8 | |
| AD-11871 | 13.9 | 4.6 | −0.4 | 86.72 | 59.8 | 62.3 | 72.1 | |
| AD-11872 | 12.4 | 9.9 | −0.2 | 81.93 | 75.1 | 77.9 | 77.9 | 79.43 |
| AD-11873 | 16.2 | 8.7 | 2.9 | 51.91 | 81.9 | 90.3 | 92.0 | |
| AD-11874 | 14.0 | 3.6 | −0.6 | 63.74 | 36.6 | 41.1 | 21.2 | |
| AD-11875 | 37.1 | 22.5 | 9.9 | 92.11 | 54.4 | 52.0 | 47.5 | 76.56 |
| AD-11876 | 11.8 | 4.2 | 1.3 | 5.85 | 35.7 | 43.8 | 50.3 | |
| AD-11878 | 3.5 | −0.5 | −1.7 | | 65.6 | 62.4 | 60.0 | |
| AD-11879 | 30.5 | 21.5 | 3.8 | 93.89 | −4.3 | −19.3 | 11.4 | 80.10 |
| AD-11882 | 16.0 | 12.4 | 5.1 | 80.92 | 9.1 | 4.8 | 19.5 | 77.03 |
| AD-11883 | 13.2 | 6.8 | 1.4 | −37.40 | −29.3 | 12.5 | 26.9 | −1048.33 |
| AD-11884 | 23.7 | 11.4 | 5.5 | 25.83 | 41.4 | 25.2 | 40.9 | −42.26 |
| AD-11885 | 1.5 | −0.8 | −2.9 | | 55.9 | 53.3 | 53.8 | |
| AD-11886 | −1.2 | −3.4 | −4.7 | | 38.7 | 47.2 | 67.9 | |
| AD-11887 | 16.6 | 4.6 | −2.2 | −85.11 | 69.8 | 54.1 | 54.1 | 85.65 |
| AD-11888 | 12.9 | 3.8 | 2.3 | | 62.2 | 66.5 | 65.7 | |
| AD-11889 | 12.2 | 5.9 | −1.6 | | 4.6 | 10.5 | 40.1 | |
| AD-11890 | 8.5 | 6.2 | 5.0 | | −41.7 | −12.9 | 20.9 | |
| AD-11891 | 20.7 | 9.8 | 1.0 | −69.47 | 19.3 | 23.9 | 32.0 | |
| AD-11892 | −0.1 | −2.5 | −2.0 | | 38.4 | 32.1 | 38.0 | |
| AD-11893 | 0.1 | −2.1 | −1.5 | | 27.1 | 21.1 | 3.1 | |
| AD-11896 | 3.5 | 1.3 | −1.6 | | 23.3 | −6.7 | 10.0 | |
| AD-11897 | 1.6 | −1.3 | −2.6 | | 26.4 | 13.7 | 13.1 | |
| AD-11899 | 8.3 | 1.9 | 0.6 | | 16.4 | 20.9 | 28.9 | |
| AD-11901 | 2.5 | 3.1 | 1.4 | | −89.3 | 71.9 | 78.6 | |
| AD-11902 | 5.9 | 0.6 | −2.6 | | −15.2 | 62.9 | 79.8 | |
| AD-11903 | 1.1 | −1.5 | −3.6 | | 64.0 | 45.9 | 45.9 | |
| AD-11904 | 0.7 | 0.4 | −0.2 | | 46.4 | 16.9 | 70.6 | |
| AD-11905 | 6.9 | 2.1 | −0.1 | | −42.4 | 42.5 | 27.9 | |
| AD-11906 | −0.4 | 0.3 | −2.5 | | 98.5 | 93.5 | 54.3 | |
| AD-11907 | 4.5 | 0.5 | −1.1 | | 95.8 | 45.3 | 95.1 | |
| AD-11908 | −0.9 | −1.7 | 0.2 | | 39.0 | 86.6 | 84.5 | |
| AD-11909 | 7.0 | 2.9 | 1.1 | | 79.1 | −27.1 | 83.9 | |
| AD-11911 | 5.4 | 2.6 | −1.9 | | 97.4 | 98.6 | 94.0 | |
| AD-11912 | −3.4 | −4.5 | −3.7 | | 99.4 | 96.2 | 65.9 | |
| AD-11914 | −0.6 | −0.2 | 1.0 | | 91.7 | 69.5 | 91.5 | |
| AD-11918 | −6.3 | −8.2 | −6.7 | | −12.4 | 9.7 | 8.0 | |
| AD-11919 | −1.0 | −0.1 | 3.2 | | 18.2 | −9.2 | 32.5 | |
| AD-11925 | 3.5 | 1.9 | −2.7 | | 11.9 | 13.7 | 13.7 | |
| AD-11926 | 11.3 | 4.9 | −3.2 | 46.95 | 16.9 | 37.0 | 66.5 | 93.16 |
| AD-11927 | −6.8 | −8.4 | −5.7 | | 45.5 | −12.2 | −17.2 | |
| AD-11933 | −0.2 | 1.4 | 3.3 | | −6.7 | 32.7 | 3.5 | |
| AD-11938 | 0.0 | −2.4 | −4.1 | | 19.2 | −45.8 | 1.4 | |
| AD-11939 | −2.3 | −2.0 | −3.1 | | 3.0 | 23.1 | 24.9 | |
| AD-11941 | −8.3 | −9.6 | −7.5 | | 42.1 | 4.0 | −25.0 | |
| AD-11942 | −4.4 | −3.5 | −2.5 | | 31.6 | 2.5 | 1.4 | |
| AD-11943 | 1.9 | 0.7 | −2.7 | | −5.6 | 20.5 | 15.4 | |
| AD-11944 | −1.1 | −2.1 | −2.0 | | 51.0 | 46.7 | 50.6 | |
| AD-11945 | −7.7 | −8.6 | −5.9 | | 77.2 | 30.5 | 55.8 | |

TABLE 3-continued

| duplex name | Ebola Zaire GFP assay % reduction | | | Ebola Zaire plaque % reduction vs no siRNA | Ebola Sudan IF assay % reduction | | | Ebola Sudan plaque % reduction vs no siRNA |
|---|---|---|---|---|---|---|---|---|
| | 100 nM | 10 nM | 1 nM | | 100 nM | 10 nM | 1 nM | |
| AD-11946 | 0.6 | 0.8 | −2.4 | | 66.9 | 65.2 | 65.4 | |
| AD-11947 | −0.6 | −2.2 | −4.1 | | 66.6 | 68.5 | 68.5 | |
| AD-11948 | −2.3 | −4.0 | −4.5 | | 77.1 | 77.6 | 88.6 | |
| AD-11949 | −6.6 | −7.9 | −6.4 | | 67.5 | 33.7 | 2.9 | |
| AD-11950 | −3.9 | 0.8 | 7.9 | | 56.0 | 51.7 | 44.8 | |
| AD-11951 | 7.7 | 0.4 | 6.0 | | 35.6 | 45.6 | 46.1 | |
| AD-11952 | 1.7 | −4.5 | −4.7 | | 54.8 | 65.7 | 66.0 | |
| AD-11953 | −9.1 | −7.7 | −6.8 | | 51.4 | 22.8 | 30.1 | |
| AD-11954 | −2.7 | 8.2 | 8.2 | | 42.1 | 26.4 | 32.1 | |
| AD-11955 | 9.0 | 7.5 | 5.9 | | 54.6 | 43.4 | 44.2 | |
| AD-11956 | 6.3 | −6.5 | −4.0 | | 28.1 | 40.0 | 55.3 | |
| AD-11957 | −1.9 | −6.4 | −2.8 | | 78.2 | 95.9 | 69.2 | |
| AD-11958 | 2.0 | 1.2 | −1.0 | | 99.7 | 89.5 | 86.2 | |
| AD-11959 | 8.7 | 3.4 | −1.2 | | 81.2 | 74.5 | 74.5 | |
| AD-11960 | 2.8 | 1.7 | 0.2 | | 71.9 | 61.4 | 82.7 | |
| AD-11961 | −3.4 | −5.5 | −4.5 | | 84.3 | 50.6 | 68.7 | |
| AD-11962 | −1.4 | 0.0 | −0.2 | | 74.1 | 89.2 | 63.9 | |
| AD-11963 | 2.1 | −0.3 | −0.2 | | 78.8 | 20.1 | 50.9 | |
| AD-11964 | 4.5 | 3.9 | −0.1 | | 61.5 | 51.0 | 58.4 | |
| AD-11965 | −3.8 | −6.3 | −4.4 | | 64.6 | 14.2 | 89.4 | |
| AD-11966 | −0.5 | −1.0 | −0.5 | | 49.5 | −30.0 | 21.4 | |
| AD-11967 | 5.0 | 3.8 | 1.2 | | 24.7 | 28.2 | 24.2 | |
| AD-11968 | −0.8 | −0.2 | −0.3 | | 9.5 | 6.5 | 26.5 | |
| AD-11969 | 3.9 | 0.6 | −2.2 | | 63.5 | 31.6 | 56.5 | |
| AD-11970 | 9.2 | 5.5 | −1.6 | | 47.6 | 36.9 | 57.1 | |
| AD-11971 | −1.2 | 0.1 | −1.7 | | 63.8 | 55.3 | 55.3 | |
| AD-11972 | 2.7 | −0.9 | −0.8 | | 66.7 | 82.1 | 78.1 | |
| AD-11973 | 3.2 | 5.3 | −0.3 | | −137.3 | −57.5 | −69.7 | |
| AD-11974 | 1.7 | 2.3 | 2.6 | | −15.1 | −41.3 | −55.7 | |
| AD-11975 | 1.8 | 1.4 | 1.9 | | −63.6 | −63.1 | −54.6 | |
| AD-11976 | 2.3 | 2.7 | 2.7 | | −8.3 | 10.1 | 29.0 | |
| AD-11977 | 4.5 | 3.7 | 2.7 | | −168.8 | −142.8 | −116.4 | |
| AD-11978 | 2.1 | 1.2 | 0.8 | | −66.5 | −91.0 | −120.2 | |
| AD-11979 | −1.7 | −2.0 | −2.2 | | −140.3 | −128.4 | −107.4 | |
| AD-11980 | −1.3 | −0.8 | −0.6 | | −21.5 | −10.2 | −14.2 | |
| AD-11981 | 9.1 | 6.7 | 4.6 | | −181.1 | −162.1 | −164.3 | |
| AD-11982 | −0.2 | −0.4 | −1.4 | | −189.5 | −148.6 | −159.6 | |
| AD-11983 | −2.7 | −3.4 | −3.7 | | −131.3 | −111.7 | −115.3 | |
| AD-11984 | −1.9 | −0.5 | 0.1 | | −36.1 | −12.9 | −10.8 | |
| AD-11985 | 5.5 | 6.4 | 2.8 | | −139.4 | −160.3 | −216.6 | |
| AD-11986 | 6.1 | 6.0 | 5.8 | | −111.7 | −143.8 | −134.7 | |
| AD-11987 | 0.9 | 1.5 | 2.0 | | −162.1 | −148.5 | −132.2 | |
| AD-11988 | 7.4 | 8.5 | 8.9 | | −196.2 | −201.7 | −178.2 | |
| AD-11989 | 1.9 | 2.0 | 1.6 | | −62.4 | −57.6 | −61.2 | |
| AD-11990 | 0.8 | −0.2 | −0.8 | | −51.3 | −69.3 | −76.8 | |
| AD-11991 | −1.9 | −2.4 | −2.3 | | −84.5 | −65.2 | −51.0 | |
| AD-11992 | 0.6 | 1.3 | 1.6 | | −83.1 | −60.4 | −57.1 | |
| AD-11993 | 6.6 | 5.6 | 3.7 | | −29.2 | −33.8 | −35.4 | |
| AD-11994 | 0.3 | 0.1 | −0.6 | | −60.1 | −59.5 | −59.4 | |
| AD-11995 | −2.3 | −2.1 | −1.9 | | −73.2 | −61.7 | −58.5 | |
| AD-11996 | −0.7 | 0.3 | 0.4 | | −4.6 | −14.0 | −21.4 | |
| AD-11997 | 4.1 | 4.3 | −0.1 | | 64.7 | 26.4 | 52.9 | |
| AD-11998 | 0.3 | 0.0 | −0.7 | | 69.1 | 61.0 | 52.1 | |
| AD-11999 | −0.5 | −0.1 | 0.1 | | 31.9 | 37.3 | 39.5 | |
| AD-12000 | −0.8 | 0.2 | 0.8 | | 51.7 | 54.7 | 60.6 | |
| AD-12001 | 3.7 | 3.3 | 2.9 | | 54.7 | 49.4 | 47.3 | |
| AD-12002 | 3.8 | 2.9 | 2.2 | | 34.0 | 49.3 | 62.0 | |
| AD-12003 | −0.3 | −0.4 | −0.2 | | 26.3 | 29.4 | 32.9 | |
| AD-12004 | 0.6 | 0.8 | 1.4 | | 37.7 | 36.6 | 36.9 | |
| AD-12005 | 4.9 | 4.7 | 3.9 | | 19.6 | 9.3 | 7.5 | |
| AD-12006 | 0.8 | 0.5 | 0.5 | | −22.4 | −23.6 | −19.4 | |
| AD-12007 | −1.3 | −0.7 | −0.3 | | −10.4 | −13.6 | −21.7 | |
| AD-12008 | 0.7 | 1.4 | 1.4 | | 31.6 | 31.4 | 33.4 | |
| AD-12009 | 0.8 | 2.5 | −2.2 | | 36.9 | 25.4 | 31.0 | |
| AD-12010 | −1.2 | −1.5 | −1.6 | | 35.6 | 23.9 | 15.8 | |
| AD-12011 | −1.2 | −0.3 | 0.2 | | 50.4 | 46.0 | 41.7 | |
| AD-12012 | 0.7 | 0.7 | 0.5 | | 47.1 | 49.2 | 51.5 | |
| AD-12013 | 1.3 | 1.1 | −0.5 | | 31.5 | 25.2 | 21.8 | |
| AD-12014 | −1.8 | −3.0 | −2.7 | | 21.5 | 26.1 | 26.3 | |
| AD-12015 | −4.2 | −4.1 | −3.8 | | 36.5 | 35.7 | 34.2 | |
| AD-12016 | −1.9 | −1.5 | −1.2 | | 38.7 | 41.0 | 41.9 | |
| AD-12017 | −0.4 | −1.0 | −2.2 | | 6.4 | 12.0 | 17.5 | |
| AD-12018 | −1.0 | −2.6 | −2.9 | | −19.0 | −8.5 | −7.1 | |

TABLE 3-continued

| duplex name | Ebola Zaire GFP assay % reduction | | | Ebola Zaire plaque % reduction vs no siRNA | Ebola Sudan IF assay % reduction | | | Ebola Sudan plaque % reduction vs no siRNA |
|---|---|---|---|---|---|---|---|---|
| | 100 nM | 10 nM | 1 nM | | 100 nM | 10 nM | 1 nM | |
| AD-12019 | −3.1 | −2.7 | −2.3 | | −3.4 | −3.2 | 0.0 | |
| AD-12020 | −2.1 | −1.4 | −1.0 | | 2.2 | 10.2 | 12.7 | |
| AD-12021 | 4.9 | 3.3 | 2.1 | | −34.2 | −9.2 | −30.6 | |
| AD-12022 | 3.9 | 3.1 | 2.1 | | −139.2 | −184.9 | −191.4 | |
| AD-12023 | 0.4 | 0.5 | 0.8 | | 10.7 | 11.7 | −2.8 | |
| AD-12024 | 0.2 | 1.4 | 2.3 | | −8.4 | 6.0 | 18.1 | |
| AD-12025 | 6.9 | 4.8 | 3.2 | | 18.0 | −1.4 | −25.4 | |
| AD-12026 | −0.3 | −0.1 | 0.2 | | −79.8 | −64.2 | −44.8 | |
| AD-12027 | −0.8 | −1.0 | −0.5 | | −28.2 | −43.7 | −57.1 | |
| AD-12028 | −1.2 | −0.2 | 0.8 | | −8.1 | −0.6 | 6.2 | |
| AD-12029 | 6.9 | 5.6 | 3.8 | | −65.2 | −79.3 | −106.3 | |
| AD-12030 | −0.1 | −0.8 | −2.0 | | −70.4 | −93.2 | −119.7 | |
| AD-12031 | 0.2 | 0.1 | −0.1 | | −32.4 | −34.4 | 34.9 | |
| AD-12032 | 0.0 | 0.1 | 0.6 | | −86.6 | −68.5 | −43.4 | |
| AD-12033 | −4.7 | −8.2 | −7.6 | | −115.7 | −149.7 | −58.5 | |
| AD-12034 | −6.0 | −5.7 | −5.7 | | −217.6 | −210.8 | −215.6 | |
| AD-12035 | −7.7 | −7.4 | −7.6 | | −99.6 | −102.4 | −107.1 | |
| AD-12036 | −6.6 | −6.1 | −5.1 | | −111.1 | −91.0 | −89.8 | |
| AD-12037 | −7.8 | −7.8 | −7.7 | | 45.1 | −5.3 | −44.2 | |
| AD-12462 | −8.4 | −8.6 | −9.4 | | −150.2 | −135.8 | −130.8 | |
| AD-12463 | −8.3 | −8.4 | −8.6 | | −70.1 | −70.9 | −75.8 | |
| AD-12464 | −6.3 | −6.6 | −6.5 | | −38.9 | −19.7 | −2.6 | |
| AD-12465 | −2.8 | −3.8 | −5.3 | | −52.8 | −75.2 | −92.9 | |
| AD-12466 | −1.9 | −3.1 | −3.5 | | −68.5 | −103.9 | −113.9 | |
| AD-12467 | −5.9 | −5.8 | −5.6 | | −118.6 | −121.8 | −117.7 | |
| AD-12468 | −4.9 | −4.2 | −3.3 | | −14.2 | −8.4 | −6.8 | |
| AD-12469 | −4.8 | −6.0 | −6.6 | | −29.1 | −6.1 | −10.2 | |
| AD-12470 | −0.9 | −1.4 | −1.9 | | −39.5 | −19.2 | −1.8 | |
| AD-12471 | −4.0 | −4.0 | −4.0 | | −15.4 | −16.3 | −17.3 | |
| AD-12472 | −3.2 | −3.4 | −2.6 | | 25.9 | 24.0 | 27.4 | |
| AD-12473 | −3.5 | −3.8 | −4.1 | | −42.5 | −31.5 | −26.4 | |
| AD-12474 | −5.0 | −5.3 | −5.8 | | −7.1 | −3.0 | −1.8 | |
| AD-12475 | −7.1 | −7.6 | −7.4 | | −10.2 | −4.3 | −0.7 | |
| AD-12476 | −5.2 | −4.7 | −3.5 | | 24.3 | 26.9 | 32.2 | |
| AD-12477 | −2.8 | −3.8 | −4.4 | | −41.4 | −45.4 | −37.6 | |
| AD-12478 | −7.3 | −7.6 | −7.8 | | −59.7 | −63.8 | −67.5 | |
| AD-12479 | −7.9 | −8.3 | −8.1 | | −54.9 | −39.3 | −8.6 | |
| AD-12480 | −2.7 | −2.4 | −1.4 | | 9.3 | 18.0 | 12.4 | |
| AD-12481 | −5.7 | −5.5 | −7.5 | | −131.4 | −152.8 | −48.2 | |
| AD-12482 | −4.4 | −4.5 | −4.1 | | −159.1 | −127.8 | −140.7 | |
| AD-12483 | −4.8 | −4.8 | −4.5 | | −66.0 | −64.8 | −60.3 | |
| AD-12484 | −4.2 | −3.9 | −3.8 | | 17.9 | 27.6 | 29.1 | |
| AD-12485 | −2.7 | −4.0 | −5.4 | | −170.2 | −176.4 | −186.0 | |
| AD-12486 | −8.5 | −8.6 | −8.6 | | −200.1 | −194.6 | −169.0 | |
| AD-12487 | −8.1 | −8.0 | −7.8 | | −117.5 | −106.8 | −86.5 | |
| AD-12488 | −8.2 | −7.9 | −7.8 | | −17.3 | −13.1 | 0.8 | |
| AD-12489 | −4.2 | −5.6 | −7.1 | | −128.0 | −152.3 | −185.8 | |
| AD-12490 | −8.6 | −8.9 | −8.8 | | −241.7 | −258.1 | −251.4 | |
| AD-12491 | −8.9 | −9.0 | −8.4 | | −181.6 | −184.9 | −188.0 | |
| AD-12492 | −8.6 | −7.7 | −6.7 | | −23.3 | −22.4 | −27.3 | |
| AD-12493 | −8.2 | −6.7 | −4.5 | | −93.8 | −54.8 | 6.7 | |
| AD-12494 | −7.6 | −8.0 | −8.2 | | −62.2 | −63.5 | −54.7 | |
| AD-12495 | −6.6 | −5.5 | −4.9 | | 16.6 | 0.4 | −10.0 | |
| AD-12496 | −4.1 | −4.2 | −3.8 | | 40.2 | 41.7 | 39.5 | |
| AD-12497 | −5.1 | −5.2 | −6.3 | | −67.9 | −65.2 | −67.3 | |
| AD-12498 | −5.8 | −6.0 | −6.4 | | −68.6 | −84.1 | −94.1 | |
| AD-12499 | −6.6 | −6.3 | −6.3 | | −93.4 | −80.2 | −61.0 | |
| AD-12500 | −6.0 | −5.4 | −4.7 | | 9.7 | 10.2 | 11.3 | |
| AD-12501 | −4.8 | −5.0 | −5.8 | | −87.1 | −108.5 | −110.6 | |
| AD-12502 | −6.8 | −7.2 | −6.7 | | −126.5 | −125.5 | −119.1 | |
| AD-12503 | −10.4 | −9.6 | −9.9 | | −85.2 | −76.4 | −86.7 | |
| AD-12504 | −4.0 | −3.6 | −2.5 | | −59.7 | −52.7 | −34.7 | |
| AD-12505 | 18.1 | −0.9 | −5.5 | 42.18 | 3.5 | −116.5 | −34.2 | −282.78 |
| AD-12506 | −2.1 | −2.7 | −4.2 | | −29.8 | −22.3 | −11.9 | |
| AD-12507 | −1.7 | 7.2 | 15.0 | 44.47 | 29.1 | 33.0 | 32.3 | |
| AD-12508 | −4.2 | −3.2 | −1.9 | | 40.7 | 33.9 | 30.5 | |
| AD-12509 | −9.2 | −8.9 | −8.2 | | −54.3 | −67.7 | −80.3 | |
| AD-12510 | −7.9 | −7.6 | −7.6 | | −127.6 | −117.5 | −124.2 | |
| AD-12511 | −7.1 | −6.9 | −6.8 | | −28.4 | −18.6 | −6.7 | |
| AD-12512 | −5.2 | −4.1 | −3.3 | | −0.4 | −1.7 | −1.5 | |
| AD-12513 | −6.9 | −7.4 | −8.8 | | −65.5 | −80.0 | −100.6 | |
| AD-12514 | −10.8 | −11.0 | −10.6 | | −83.8 | −85.0 | −92.0 | |
| AD-12515 | −10.7 | −9.6 | −9.3 | | −19.3 | −41.2 | −32.7 | |

TABLE 3-continued

| duplex name | Ebola Zaire GFP assay % reduction | | | Ebola Zaire plaque % reduction vs no siRNA | Ebola Sudan IF assay % reduction | | | Ebola Sudan plaque % reduction vs no siRNA |
|---|---|---|---|---|---|---|---|---|
| | 100 nM | 10 nM | 1 nM | | 100 nM | 10 nM | 1 nM | |
| AD-12516 | −5.8 | −5.3 | −4.2 | | −5.9 | 0.9 | 15.9 | |
| AD-12517 | −8.6 | −8.7 | −7.1 | | 29.2 | 53.0 | 49.4 | |
| AD-12518 | −8.3 | −8.0 | −8.0 | | 65.7 | 57.8 | 53.6 | |
| AD-12519 | −7.2 | −7.2 | −7.6 | | 51.2 | 51.3 | 53.9 | |
| AD-12520 | −7.0 | −6.3 | −5.4 | | 67.7 | 73.2 | 78.8 | |
| AD-12521 | −6.4 | −8.0 | −9.1 | | 19.8 | 27.6 | 35.5 | |
| AD-12522 | −9.9 | −9.0 | −9.1 | | 50.3 | 43.0 | 34.3 | |
| AD-12523 | −9.0 | −8.7 | −8.9 | | 28.3 | 31.9 | 38.1 | |
| AD-12524 | −7.0 | −7.4 | −7.0 | | 63.7 | 67.1 | 65.9 | |
| AD-12525 | −1.6 | −3.8 | −6.0 | | 16.1 | 21.8 | 21.2 | |

TABLE 4

In vitro Plaque assay controls (all values average of 3-4 experiments and expressed as % inhibition relative to no siRNA treatment)

| AD-1955 (luc) | 31.37 | 10.97 |
| AD-5179 (GFP) | 15.15 | 18.65 |
| LS L#1 | 77.23 | N/A |
| LS NP#1 | 73.94 | N/A |
| LS VP35#1 | 67.27 | N/A |

TABLE 5

| parent duplex | Exo + Endo light duplex | Target | sense | antisense | seq id no | sense 5'-3' | seq id no | antisense 5'-3' |
|---|---|---|---|---|---|---|---|---|
| AD-11594 | AD-3542 | NP | A-30769 | A-30769 | 995 | cAGuAGGAcAcAuGAuGGucTsdT | 996 | ACcAUcAUGUGUCCuACUGdTsdT |
| AD-11596 | AD-3543 | NP | A-30770 | A-30771 | 997 | GuAGGAcAcAuGAuGGuGAdTsdT | 998 | UcACcAUcAUGUGUCCuACdTsdT |
| AD-11597 | AD-3544 | NP | A-30772 | A-30773 | 999 | uAGGAcAcAuGAuGGuGAucdTsdT | 1000 | AUcACcAUcAUGUGUCCuAdTsdT |
| AD-11598 | AD-3545 | NP | A-30774 | A-30775 | 1001 | GAuGGuGAuuuuccGuuuGdTsdT | 1002 | cAAACGGAAAAUcACcAUCdTscT |
| AD-11600 | AD-3546 | NP | A-30776 | A-30777 | 1003 | uGGuGAuuuuccGuuuGAdTsdT | 1004 | AUcAAACGGAAAAUcACcAdTsdT |
| AD-11603 | AD-3547 | NP | A-30778 | A-30779 | 1005 | cuGAGAAGcAAcuccAAcAcTsdT | 1006 | UGUUGGAGUUGCUUCUcAGcTsdT |
| AD-11604 | AD-3548 | NP | A-30780 | A-30781 | 1007 | uGAGAAGcAAcuccAAcAAdTsdT | 1008 | UUGUUGGAGUUGCUUCUcAdTsdT |
| AD-11606 | AD-3549 | NP | A-30782 | A-30783 | 1009 | AGAAGcAAcuccAAcAAuAdTsdT | 1010 | uAUUGUUGGAGUUGCUUCUdTsdT |
| AD-11609 | AD-3550 | VP35 | A-30784 | A-30785 | 1011 | AAGuAuGAAGAuuAAGAAdTsdT | 1012 | UUCUuAAUCUUcAUcACUUdTsdT |
| AD-11610 | AD-3551 | VP35 | A-30786 | A-30787 | 1013 | AGuAuGAAGAuuAAGAAAdTsdT | 1014 | UUUCUuAAUCUUcAUcACUdTsdT |
| AD-11611 | AD-3552 | VP40 | A-30788 | A-30789 | 1015 | cuGccuGcuGcAAcAuGGAdTsdT | 1016 | UCcAUGUUGcAGcAGGcAGdTsdT |
| AD-11613 | AD-3553 | GP | A-307901 | A-30791 | 1017 | GGcuGAAAAcuGcuAcAAuTsdT | 1018 | AUUGuAGcAGUUUUcAGCCdTsdT |
| AD-11614 | AD-3554 | GP | A-30792 | A-30793 | 1051 | GcuGAAAAcuGcuAcAAucdTscT | 1052 | GAUUGuAGcAGUUUUcAGCdTsdT |
| AD-11615 | AD-3555 | GP | A-30794 | A-30795 | 1053 | cuGAAAAcuGcuAcAAucudTsdT | 1054 | AGAUUGuAGcAGUUUUcAGdTsdT |
| AD-11618 | AD-3556 | GP | A-30796 | A-30797 | 1055 | AAAAcuGcuAcAAucuuGAdTsdT | 1056 | UcAAGAUUGuAGcAGUUUUcTsdT |
| AD-11621 | AD-3557 | GP | A-30798 | A-30799 | 1057 | AcuGcuAcAAucuuGAAAudTsdT | 1058 | AUUUcAAGAUUGuAGcAGUdTscT |
| AD-11622 | AD-3558 | VP30 | A-30800 | A-30801 | 1059 | AGcAAAuccAAcGGcuGAudTsdT | 1060 | AUcAGCCGUUGGAUUUGCUdTsdT |
| AD-11624 | AD-3559 | VP30 | A-30802 | A-30803 | 1061 | cAAAuccAAcGGcuGAuGAdTsdT | 1062 | UcAUcAGCCGUUGGAUUUGdTsdT |
| AD-11627 | AD-3560 | L | A-30804 | A-30805 | 1063 | AuGcAuGucAGuGAuuAuudTsdT | 1064 | AAuAAUcACUGAcAUGcAUdTsdT |
| AD-11628 | AD-3561 | L | A-30806 | A-30807 | 1065 | uGcAuGucAGuGAuuAuuAdTsdT | 1066 | uAAuAAUcACUGAcAUGcAdTsdT |

TABLE 5-continued

| parent duplex | Exo + Endo light duplex | Target | sense | antisense | seq id no | sense 5'-3' | seq id no | antisense 5'-3' |
|---|---|---|---|---|---|---|---|---|
| AD-11629 | AD-3562 | L | A-30808 | A-30809 | 1067 | GcAuGucAGuGAuuAuuAuAdTsdT | 1068 | AuAAuAAUcACUGAcAUGCdTsdT |
| AD-11630 | AD-3563 | L | A-30810 | A-30811 | 1069 | cAuGucAGuGAuuAuuAuAdTsdT | 1070 | uAuAAuAAUcACUGAcAUGdTsdT |
| AD-11631 | AD-3564 | L | A-30812 | A-30813 | 1071 | AuGucAGuGAuuAuuAuAAdTsdT | 1072 | UuAuAAuAAUcACUGAcAUdTsdT |

TABLE 6

| modified duplex | In vitro plasmid screen IC50 (nM) | In vitro plaque assay against Ebola-Zaire (% inhibition relative to no siRNA) | In vitro plaque assay against Ebola-Sudan (% inhibition relative to no siRNA) |
|---|---|---|---|
| AD-3542 | 1.60 | 84% | 74% |
| AD-3543 | 0.00 | 74% | 77% |
| AD-3544 | 0.61 | 65% | 13% |
| AD-3545 | 0.00 | 82% | 61% |
| AD-3546 | 1.35 | 88% | 71% |
| AD-3547 | 0.00 | 81% | 26% |
| AD-3548 | 7.82 | 68% | 73% |
| AD-3549 | 0.00 | 68% | 74% |
| AD-3550 | 0.17 | 77% | 22% |
| AD-3551 | 0.08 | 2% | 75% |
| AD-3552 | 0.00 | 78% | 70% |
| AD-3553 | 0.19 | 85% | 26% |
| AD-3554 | 0.77 | 84% | 15% |
| AD-3555 | 0.88 | −5% | 19% |
| AD-3556 | 0.00 | 73% | 74% |
| AD-3557 | 0.21 | 100% | 28% |
| AD-3558 | 0.00 | −7% | 68% |
| AD-3559 | 0.00 | −252% | −7% |
| AD-3560 | 0.50 | 16% | −35% |
| AD-3561 | 0.00 | −105% | 19% |
| AD-3562 | 0.00 | −75% | 63% |
| AD-3563 | 5.42 | 73% | −17% |
| AD-3564 | 0.97 | −86% | 19% |
| AD-3621 | 0.00 | 80% | 48% |
| AD-3622 | 16.00 | 61% | 47% |
| AD-3623 | 0.00 | 98% | 37% |
| AD-3624 | 0.00 | 84% | 24% |
| AD-3625 | 0.00 | −7% | −5% |
| AD-3626 | 0.00 | 53% | 31% |

TABLE 7

| IFN induction normalized to positive control siRNA | | TNF induction normalized to positive control siRNA | |
|---|---|---|---|
| duplex | % of control | duplex | % of control |
| AD-11546 | 131.6 | AD-11546 | 30.1 |
| AD-11558 | 98.8 | AD-11558 | 57.2 |
| AD-11570 | 0 | AD-11570 | 0 |
| AD-11588 | 147 | AD-11588 | 0.0 |
| AD-11590 | 0.0 | AD-11590 | 130.5 |
| AD-11594 | 17.8 | AD-11594 | 124.8 |
| AD-11597 | 22.0 | AD-11597 | 242.9 |
| AD-11598 | 25.7 | AD-11598 | 180.3 |
| AD-11599 | 136 | AD-11599 | 183.9 |
| AD-11600 | 13.5 | AD-11600 | 141.0 |
| AD-11603 | 69.0 | AD-11603 | 81.4 |
| AD-11606 | 33.2 | AD-11606 | 79.8 |
| AD-11609 | 126.9 | AD-11609 | 46.3 |
| AD-11610 | 138.2 | AD-11610 | 48.5 |
| AD-11611 | 43.2 | AD-11611 | 41.0 |
| AD-11613 | 167.0 | AD-11613 | 52.6 |
| AD-11614 | 162.1 | AD-11614 | 48.1 |
| AD-11615 | 171.2 | AD-11615 | 60.0 |
| AD-11618 | 137.3 | AD-11618 | 54.6 |
| AD-11621 | 0.0 | AD-11621 | 325.8 |
| AD-11622 | 37.2 | AD-11622 | 28.5 |
| AD-11623 | 58.0 | AD-11623 | 26.0 |
| AD-11624 | 63.2 | AD-11624 | 29.2 |
| AD-11627 | 6.4 | AD-11627 | 125.0 |
| AD-11628 | 0.0 | AD-11628 | 101.1 |
| AD-11630 | 0.0 | AD-11630 | 170.3 |
| AD-11631 | 0.0 | AD-11631 | 156.0 |
| AD-11644 | 0 | AD-11644 | 0.0 |
| AD-11650 | 0.0 | AD-11650 | 0.0 |
| AD-11659 | 0.0 | AD-11659 | 69.0 |
| AD-11673 | 9.2 | AD-11673 | 0.0 |
| AD-11678 | 0.0 | AD-11678 | 0.0 |
| AD-11683 | 0.0 | AD-11683 | 19.6 |
| AD-11684 | 0.0 | AD-11684 | 24.3 |
| AD-11691 | 0 | AD-11691 | 0.0 |
| AD-11695 | 0.0 | AD-11695 | 5.2 |
| AD-11698 | 5.3 | AD-11698 | 14.0 |
| AD-11706 | 0.0 | AD-11706 | 0.0 |
| AD-11707 | 0 | AD-11707 | 0.0 |
| AD-11710 | 0 | AD-11710 | 0.0 |
| AD-11721 | 0.0 | AD-11721 | 0.0 |
| AD-11725 | 0.0 | AD-11725 | 0.0 |
| AD-11732 | 0.0 | AD-11732 | 0.0 |
| AD-11743 | 16.1 | AD-11743 | 0.0 |
| AD-11756 | 0.0 | AD-11756 | 0.0 |
| AD-11757 | 0.0 | AD-11757 | 0.0 |
| AD-11758 | 0.0 | AD-11758 | 0.0 |
| AD-11759 | 0.0 | AD-11759 | 0.0 |
| AD-11773 | 0.0 | AD-11773 | 0.0 |
| AD-11780 | 0.0 | AD-11780 | 7.9 |
| AD-11789 | 0.0 | AD-11789 | 5.7 |
| AD-11804 | 0.0 | AD-11804 | 0.0 |
| AD-11811 | 0.0 | AD-11811 | 0.0 |
| AD-11814 | 0.0 | AD-11814 | 0.0 |
| AD-11816 | 0.0 | AD-11816 | 0.0 |
| AD-11822 | 9.8 | AD-11822 | 0.0 |
| AD-11823 | 0.0 | AD-11823 | 0.0 |
| AD-11832 | 0.0 | AD-11832 | 0.0 |
| AD-11836 | 0.0 | AD-11836 | 0.0 |
| AD-11939 | 0.0 | AD-11939 | 0.0 |
| AD-11976 | 0.0 | AD-11976 | 0.0 |
| AD-11982 | 6.9 | AD-11982 | 15.1 |
| AD-11990 | 12.2 | AD-11990 | 0.0 |
| AD-11992 | 7.3 | AD-11992 | 0.0 |
| AD-12007 | 0.0 | AD-12007 | 0.0 |
| AD-12013 | 0.0 | AD-12013 | 0.0 |
| AD-12019 | 24.6 | AD-12019 | 5.0 |
| AD-12024 | 0.0 | AD-12024 | 19.8 |
| AD-12035 | 0.0 | AD-12035 | 8.5 |
| AD-12475 | 0.0 | AD-12475 | 0.0 |
| AD-12484 | 21.0 | AD-12484 | 9.5 |
| AD-12491 | 0.0 | AD-12491 | 13.1 |
| AD-12500 | 12.6 | AD-12500 | 53.3 |
| AD-12502 | 101.6 | AD-12502 | 55.5 |
| AD-3542 | 0.0 | AD-3542 | 0.0 |
| AD-3543 | 0.0 | AD-3543 | 0.0 |
| AD-3544 | 10.1 | AD-3544 | 0.0 |

TABLE 7-continued

| duplex | IFN induction normalized to positive control siRNA % of control | duplex | TNF induction normalized to positive control siRNA % of control |
|---|---|---|---|
| AD-3545 | 11.8 | AD-3545 | 0.0 |
| AD-3546 | 0.0 | AD-3546 | 0.0 |
| AD-3547 | 0.0 | AD-3547 | 31.0 |
| AD-3548 | 0.0 | AD-3548 | 5.9 |
| AD-3549 | 0.0 | AD-3549 | 10.8 |
| AD-3550 | 7.4 | AD-3550 | 0.0 |
| AD-3551 | 0.0 | AD-3551 | 0.0 |
| AD-3552 | 0.0 | AD-3552 | 0.0 |
| AD-3553 | 0.0 | AD-3553 | 0.0 |
| AD-3554 | 0.0 | AD-3554 | 11.5 |
| AD-3555 | 0.0 | AD-3555 | 6.2 |
| AD-3556 | 0.0 | AD-3556 | 9.1 |
| AD-3557 | 0.0 | AD-3557 | 0.0 |
| AD-3558 | 0.0 | AD-3558 | 5.8 |
| AD-3559 | 0.0 | AD-3559 | 5.3 |
| AD-3560 | 0.0 | AD-3560 | 0.0 |
| AD-3561 | 0.0 | AD-3561 | 0.0 |
| AD-3562 | 0.0 | AD-3562 | 0.0 |
| AD-3563 | 0.0 | AD-3563 | 0.0 |
| AD-3564 | 0.0 | AD-3564 | 0.0 |
| AD-3621 | 0.0 | AD-3621 | 0.0 |
| AD-3622 | 0.0 | AD-3622 | 0.0 |
| AD-3623 | 5.7 | AD-3623 | 0.0 |
| AD-3624 | 10.0 | AD-3624 | 0.0 |
| AD-3625 | 0.0 | AD-3625 | 0.0 |
| AD-3626 | 0.0 | AD-3626 | 0.0 |

TABLE 8

| duplex name | In vitro plasmid screen single dose (% silencing) | In vitro plasmid screen IC50 (nM) |
|---|---|---|
| AD-11542 | 9% | |
| AD-11543 | −3% | |
| AD-11544 | −1% | |
| AD-11545 | 13% | |
| AD-11546 | 68% | 0.72 |
| AD-11547 | 28% | |
| AD-11548 | 48% | |
| AD-11549 | 43% | |
| AD-11550 | −5% | |
| AD-11551 | 8% | |
| AD-11552 | −17% | |
| AD-11553 | −6% | |
| AD-11554 | 15% | |
| AD-11555 | 2% | |
| AD-11556 | 6% | |
| AD-11557 | −6% | |
| AD-11558 | 70% | 0.46 |
| AD-11559 | 28% | |
| AD-11560 | 5% | |
| AD-11561 | 30% | |
| AD-11562 | 24% | |
| AD-11563 | 6% | |
| AD-11564 | 0% | |
| AD-11565 | −4% | |
| AD-11566 | 4% | |
| AD-11567 | −2% | |
| AD-11568 | 0% | |
| AD-11569 | 12% | |
| AD-11570 | 73% | 0.95 |
| AD-11571 | −2% | |
| AD-11572 | −3% | |
| AD-11573 | 2% | |
| AD-11574 | 15% | |
| AD-11575 | −2% | |
| AD-11576 | −9% | |

TABLE 8-continued

| duplex name | In vitro plasmid screen single dose (% silencing) | In vitro plasmid screen IC50 (nM) |
|---|---|---|
| AD-11577 | −9% | |
| AD-11578 | 77% | |
| AD-11579 | 37% | |
| AD-11580 | 35% | |
| AD-11581 | 60% | |
| AD-11582 | 21% | |
| AD-11583 | 47% | |
| AD-11584 | 0% | |
| AD-11585 | −1% | |
| AD-11586 | 36% | |
| AD-11587 | 66% | |
| AD-11588 | 47% | |
| AD-11589 | 77% | |
| AD-11590 | 83% | 0.57 |
| AD-11591 | 65% | |
| AD-11592 | 62% | |
| AD-11593 | 55% | |
| AD-11594 | 85% | 0.35 |
| AD-11595 | 72% | |
| AD-11596 | 84% | 0.24 |
| AD-11597 | 85% | 0.33 |
| AD-11598 | 87% | 0.21 |
| AD-11599 | 91% | 0.81 |
| AD-11600 | 89% | 0.29 |
| AD-11601 | 84% | 1.07 |
| AD-11602 | 71% | |
| AD-11603 | 80% | 1.3 |
| AD-11604 | 81% | 1.44 |
| AD-11605 | 75% | |
| AD-11606 | 78% | 6.38 |
| AD-11607 | 53% | |
| AD-11608 | 60% | |
| AD-11609 | 75% | 0.3 |
| AD-11610 | 74% | 0.15 |
| AD-11611 | 61% | 0.28 |
| AD-11612 | −5% | |
| AD-11613 | 84% | 0.077 |
| AD-11614 | 85% | 0.102 |
| AD-11615 | 79% | 0.211 |
| AD-11616 | 66% | |
| AD-11617 | 59% | |
| AD-11618 | 78% | 0.24 |
| AD-11619 | 57% | |
| AD-11620 | 64% | |
| AD-11621 | 74% | 0.15 |
| AD-11622 | 70% | 0.41 |
| AD-11623 | 67% | 0.54 |
| AD-11624 | 75% | 0.15 |
| AD-11625 | 11% | |
| AD-11626 | 51% | |
| AD-11627 | 71% | 0.28 |
| AD-11628 | 68% | 0.33 |
| AD-11629 | 75% | 0.18 |
| AD-11630 | 73% | 0.24 |
| AD-11631 | 69% | 0.31 |
| AD-11632 | 53% | |
| AD-11633 | 63% | 1.78 |
| AD-11634 | 65% | 0.76 |
| AD-11635 | 29% | |
| AD-11636 | 43% | |
| AD-11637 | −5% | |
| AD-11638 | 6% | |
| AD-11639 | 2% | |
| AD-11640 | 38% | |
| AD-11641 | 35% | |
| AD-11642 | 55% | |
| AD-11643 | 33% | |
| AD-11644 | 36% | |
| AD-11645 | 45% | |
| AD-11646 | 37% | |
| AD-11647 | 41% | |
| AD-11648 | 61% | |

TABLE 8-continued

| duplex name | In vitro plasmid screen single dose (% silencing) | In vitro plasmid screen IC50 (nM) |
|---|---|---|
| AD-11649 | 35% | |
| AD-11650 | 84% | 0.7 |
| AD-11651 | 13% | |
| AD-11652 | 64% | |
| AD-11653 | 61% | |
| AD-11654 | 6% | |
| AD-11655 | 59% | |
| AD-11656 | 38% | |
| AD-11657 | 39% | |
| AD-11658 | 59% | |
| AD-11659 | 82% | 0.038 |
| AD-11660 | 39% | |
| AD-11661 | −5% | |
| AD-11662 | −1% | |
| AD-11663 | 14% | |
| AD-11664 | 19% | |
| AD-11665 | 7% | |
| AD-11666 | −4% | |
| AD-11667 | −14% | |
| AD-11668 | 63% | |
| AD-11669 | 28% | |
| AD-11670 | 23% | |
| AD-11671 | 23% | |
| AD-11672 | 15% | |
| AD-11673 | 79% | 0.117 |
| AD-11674 | 67% | |
| AD-11675 | 46% | |
| AD-11676 | 20% | |
| AD-11677 | 34% | |
| AD-11678 | 79% | 0.149 |
| AD-11679 | 51% | |
| AD-11680 | 24% | |
| AD-11681 | 72% | |
| AD-11682 | 73% | |
| AD-11683 | 88% | 0.056 |
| AD-11684 | 80% | 0.184 |
| AD-11685 | 33% | |
| AD-11686 | 72% | |
| AD-11687 | 32% | |
| AD-11688 | 15% | |
| AD-11689 | 58% | |
| AD-11690 | 26% | |
| AD-11691 | 60% | |
| AD-11694 | 54% | |
| AD-11695 | 81% | 0.46 |
| AD-11696 | 32% | |
| AD-11698 | 73% | 0.2 |
| AD-11700 | −9% | |
| AD-11704 | 35% | |
| AD-11705 | 39% | |
| AD-11706 | 67% | 0.56 |
| AD-11707 | 2% | |
| AD-11708 | −10% | |
| AD-11710 | 65% | 4.57 |
| AD-11711 | −3% | |
| AD-11712 | 17% | |
| AD-11713 | 0% | |
| AD-11714 | 42% | |
| AD-11715 | 41% | |
| AD-11716 | 18% | |
| AD-11717 | 32% | |
| AD-11718 | −3% | |
| AD-11719 | 36% | |
| AD-11720 | 41% | |
| AD-11721 | 68% | 1.35 |
| AD-11722 | 31% | |
| AD-11723 | 49% | |
| AD-11724 | 27% | |
| AD-11725 | 67% | 0.34 |
| AD-11726 | 12% | |
| AD-11727 | 3% | |
| AD-11728 | 5% | |
| AD-11729 | 12% | |
| AD-11730 | 6% | |
| AD-11731 | 63% | 49.4 |
| AD-11732 | 76% | 2.88 |
| AD-11733 | 60% | 8.76 |
| AD-11734 | 44% | |
| AD-11735 | 17% | |
| AD-11736 | 44% | |
| AD-11737 | 14% | |
| AD-11738 | −9% | |
| AD-11739 | 23% | |
| AD-11740 | 1% | |
| AD-11741 | 9% | |
| AD-11742 | 40% | |
| AD-11743 | 77% | 0.11 |
| AD-11744 | 24% | |
| AD-11745 | 27% | |
| AD-11746 | −9% | |
| AD-11747 | 16% | |
| AD-11748 | 8% | |
| AD-11749 | | |
| AD-11750 | 33% | |
| AD-11751 | 19% | |
| AD-11752 | 61% | 6.92 |
| AD-11753 | 13% | |
| AD-11754 | 53% | |
| AD-11755 | | |
| AD-11756 | 61% | 1.21 |
| AD-11757 | 63% | 1.57 |
| AD-11758 | 28% | |
| AD-11759 | 66% | 1.61 |
| AD-11760 | 64% | 3.4 |
| AD-11761 | 59% | |
| AD-11762 | 54% | |
| AD-11763 | 47% | |
| AD-11764 | 21% | |
| AD-11765 | −1% | |
| AD-11766 | −1% | |
| AD-11767 | 67% | 4.4 |
| AD-11768 | 52% | |
| AD-11769 | 21% | |
| AD-11770 | 55% | |
| AD-11771 | 36% | |
| AD-11772 | 41% | |
| AD-11773 | 76% | 0.37 |
| AD-11774 | 35% | |
| AD-11775 | 49% | |
| AD-11776 | 50% | |
| AD-11777 | −5% | |
| AD-11778 | 18% | |
| AD-11779 | 15% | |
| AD-11780 | 62% | 0.76 |
| AD-11781 | 14% | |
| AD-11782 | 38% | |
| AD-11783 | 46% | |
| AD-11784 | 23% | |
| AD-11785 | −11% | |
| AD-11786 | 42% | |
| AD-11787 | 48% | |
| AD-11788 | 19% | |
| AD-11789 | 64% | 0.38 |
| AD-11790 | 26% | |
| AD-11791 | 22% | |
| AD-11792 | −8% | |
| AD-11793 | 26% | |
| AD-11794 | 57% | |
| AD-11795 | | |
| AD-11796 | 59% | |
| AD-11797 | 11% | |
| AD-11798 | 11% | |
| AD-11799 | 35% | |
| AD-11800 | 2% | |

TABLE 8-continued

| duplex name | In vitro plasmid screen single dose (% silencing) | In vitro plasmid screen IC50 (nM) |
|---|---|---|
| AD-11801 | −6% | |
| AD-11802 | 0% | |
| AD-11803 | 5% | |
| AD-11804 | 88% | 0.281 |
| AD-11805 | 5% | |
| AD-11806 | 9% | |
| AD-11807 | 6% | |
| AD-11808 | 50% | |
| AD-11809 | 24% | |
| AD-11810 | −1% | |
| AD-11811 | 66% | 1.56 |
| AD-11812 | 1% | |
| AD-11813 | 17% | |
| AD-11814 | 65% | 0.43 |
| AD-11815 | −1% | |
| AD-11816 | 65% | 0.99 |
| AD-11817 | 67% | 2.98 |
| AD-11818 | 44% | |
| AD-11819 | 64% | |
| AD-11820 | 36% | |
| AD-11821 | 64% | |
| AD-11822 | 62% | 1.44 |
| AD-11823 | 69% | 0.32 |
| AD-11824 | 38% | |
| AD-11825 | 18% | |
| AD-11826 | 23% | |
| AD-11827 | 2% | |
| AD-11828 | 51% | |
| AD-11829 | | |
| AD-11830 | 46% | |
| AD-11831 | 20% | |
| AD-11832 | 71% | 0.94 |
| AD-11833 | 3% | |
| AD-11834 | 23% | |
| AD-11835 | −8% | |
| AD-11836 | 65% | 1.46 |
| AD-11837 | 26% | |
| AD-11838 | −16% | |
| AD-11839 | 22% | |
| AD-11840 | −5% | |
| AD-11841 | 60% | |
| AD-11842 | 19% | |
| AD-11843 | 57% | |
| AD-11844 | 18% | |
| AD-11845 | 8% | |
| AD-11846 | 48% | |
| AD-11847 | 57% | |
| AD-11848 | 2% | |
| AD-11849 | 66% | 0.32 |
| AD-11850 | 25% | |
| AD-11851 | −12% | |
| AD-11852 | 27% | |
| AD-11853 | 28% | |
| AD-11854 | 55% | |
| AD-11855 | 43% | |
| AD-11856 | −20% | |
| AD-11857 | 61% | 3.28 |
| AD-11858 | 6% | |
| AD-11859 | 4% | |
| AD-11860 | 79% | |
| AD-11861 | 31% | |
| AD-11862 | 48% | |
| AD-11863 | 85% | 0.39 |
| AD-11864 | 42% | |
| AD-11865 | 37% | |
| AD-11870 | 34% | |
| AD-11871 | 79% | 0.63 |
| AD-11872 | 70% | |
| AD-11873 | 70% | |
| AD-11874 | 39% | |
| AD-11875 | 39% | |
| AD-11876 | 34% | |
| AD-11878 | −1% | |
| AD-11879 | 50% | |
| AD-11882 | −6% | |
| AD-11883 | 11% | |
| AD-11884 | 7% | |
| AD-11885 | −3% | |
| AD-11886 | −5% | |
| AD-11887 | 18% | |
| AD-11888 | 41% | |
| AD-11889 | 1% | |
| AD-11890 | 44% | |
| AD-11891 | 20% | |
| AD-11892 | 37% | |
| AD-11893 | 29% | |
| AD-11896 | 1% | |
| AD-11897 | 41% | |
| AD-11899 | 12% | |
| AD-11901 | −2% | |
| AD-11902 | 40% | |
| AD-11903 | 14% | |
| AD-11904 | 1% | |
| AD-11905 | 33% | |
| AD-11906 | 2% | |
| AD-11907 | 9% | |
| AD-11908 | 5% | |
| AD-11909 | 16% | |
| AD-11911 | 37% | |
| AD-11912 | 19% | |
| AD-11914 | 19% | |
| AD-11918 | 1% | |
| AD-11919 | −1% | |
| AD-11925 | −5% | |
| AD-11926 | 60% | |
| AD-11927 | −11% | |
| AD-11933 | 30% | |
| AD-11938 | 6% | |
| AD-11939 | 71% | 0.48 |
| AD-11941 | 47% | |
| AD-11942 | 33% | |
| AD-11943 | 48% | |
| AD-11944 | 51% | |
| AD-11945 | 69% | |
| AD-11946 | 39% | |
| AD-11947 | 39% | |
| AD-11948 | 83% | 0.68 |
| AD-11949 | 41% | |
| AD-11950 | 73% | |
| AD-11951 | 55% | |
| AD-11952 | 81% | 1.42 |
| AD-11953 | 52% | |
| AD-11954 | 55% | |
| AD-11955 | 79% | 0.63 |
| AD-11956 | 37% | |
| AD-11957 | 39% | |
| AD-11958 | 34% | |
| AD-11959 | 36% | |
| AD-11960 | 19% | |
| AD-11961 | −4% | |
| AD-11962 | −6% | |
| AD-11963 | 3% | |
| AD-11964 | 13% | |
| AD-11965 | 28% | |
| AD-11966 | −4% | |
| AD-11967 | 15% | |
| AD-11968 | 4% | |
| AD-11969 | 0% | |
| AD-11970 | −7% | |
| AD-11971 | 3% | |
| AD-11972 | 58% | |
| AD-11973 | 4% | |
| AD-11974 | 38% | |
| AD-11975 | −11% | |

TABLE 8-continued

| duplex name | In vitro plasmid screen single dose (% silencing) | In vitro plasmid screen IC50 (nM) |
|---|---|---|
| AD-11976 | 63% | 0.21 |
| AD-11977 | 2% | |
| AD-11978 | 56% | |
| AD-11979 | 5% | |
| AD-11980 | 5% | |
| AD-11981 | 19% | |
| AD-11982 | 65% | 0.14 |
| AD-11983 | 52% | |
| AD-11984 | 50% | |
| AD-11985 | 50% | |
| AD-11986 | 6% | |
| AD-11987 | −7% | |
| AD-11988 | 58% | |
| AD-11989 | 27% | |
| AD-11990 | 72% | 0.24 |
| AD-11991 | 29% | |
| AD-11992 | 76% | 0.94 |
| AD-11993 | 46% | |
| AD-11994 | 21% | |
| AD-11995 | −3% | |
| AD-11996 | 53% | |
| AD-11997 | 0% | |
| AD-11998 | 3% | |
| AD-11999 | 19% | |
| AD-12000 | 41% | |
| AD-12001 | 3% | |
| AD-12002 | 37% | |
| AD-12003 | 17% | |
| AD-12004 | 5% | |
| AD-12005 | 6% | |
| AD-12006 | 69% | |
| AD-12007 | 81% | 0.268 |
| AD-12008 | 35% | |
| AD-12009 | 22% | |
| AD-12010 | 34% | |
| AD-12011 | 10% | |
| AD-12012 | 25% | |
| AD-12013 | 75% | 0.60 |
| AD-12014 | 29% | |
| AD-12015 | 4% | |
| AD-12016 | 2% | |
| AD-12017 | 5% | |
| AD-12018 | 7% | |
| AD-12019 | 79% | 0.904 |
| AD-12020 | 6% | |
| AD-12021 | 0% | |
| AD-12022 | 2% | |
| AD-12023 | 16% | |
| AD-12024 | 87% | 0.075 |
| AD-12025 | 4% | |
| AD-12026 | 5% | |
| AD-12027 | 66% | |
| AD-12028 | 24% | |
| AD-12029 | −8% | |
| AD-12030 | 46% | |
| AD-12031 | 48% | |
| AD-12032 | −10% | |
| AD-12033 | 64% | 6.74 |
| AD-12034 | 45% | |
| AD-12035 | 70% | 0.11 |
| AD-12036 | 43% | |
| AD-12037 | | |
| AD-12462 | 35% | |
| AD-12463 | 39% | |
| AD-12464 | 47% | |
| AD-12465 | 34% | |
| AD-12466 | 35% | |
| AD-12467 | 25% | |
| AD-12468 | −9% | |
| AD-12469 | −3% | |
| AD-12470 | 50% | |
| AD-12471 | 12% | |
| AD-12472 | 9% | |
| AD-12473 | 52% | |
| AD-12474 | 1% | |
| AD-12475 | 62% | 0.13 |
| AD-12476 | 19% | |
| AD-12477 | −12% | |
| AD-12478 | 5% | |
| AD-12479 | 21% | |
| AD-12480 | 13% | |
| AD-12481 | 22% | |
| AD-12482 | 65% | |
| AD-12483 | 78% | |
| AD-12484 | 90% | 0.023 |
| AD-12485 | 76% | |
| AD-12486 | 13% | |
| AD-12487 | 60% | |
| AD-12488 | 54% | |
| AD-12489 | 11% | |
| AD-12490 | 72% | |
| AD-12491 | 86% | 0.047 |
| AD-12492 | 41% | |
| AD-12493 | 26% | |
| AD-12494 | 12% | |
| AD-12495 | 69% | |
| AD-12496 | 44% | |
| AD-12497 | 2% | |
| AD-12498 | 14% | |
| AD-12499 | 63% | |
| AD-12500 | 86% | 0.057 |
| AD-12501 | 57% | |
| AD-12502 | 88% | 0.048 |
| AD-12503 | −2% | |
| AD-12504 | 8% | |
| AD-12505 | 29% | |
| AD-12506 | 31% | |
| AD-12507 | 48% | |
| AD-12508 | 47% | |
| AD-12509 | 2% | |
| AD-12510 | −21% | |
| AD-12511 | 28% | |
| AD-12512 | 43% | |
| AD-12513 | −22% | |
| AD-12514 | 38% | |
| AD-12515 | −9% | |
| AD-12516 | 58% | |
| AD-12517 | 18% | |
| AD-12518 | −8% | |
| AD-12519 | −5% | |
| AD-12520 | 62% | 1.12 |
| AD-12521 | −12% | |
| AD-12522 | 53% | |
| AD-12523 | 55% | |
| AD-12524 | 60% | |
| AD-12525 | 32% | |

TABLE 9

| | | WBC | Platelets | Lymphocyte # |
|---|---|---|---|---|
| Animal #1 (AD-11570 treatment) | day 0 | 7.1 | 328 | 2 |
| | day 3 | 6.9 | 308 | 1.9 |
| | day 5 | 6.2 | 394 | 3.4 |
| Animal #2 (AD-11570 treatment) | day 0 | 3.6 | 299 | 1.5 |
| | day 3 | 10.9 | 254 | 1.5 |
| | day 5 | 12.9 | 281 | 1.8 |
| | day 8 | 21.2 | 444 | 4.3 |
| Animal #3 (AD-11570 | day 0 | 3.2 | 218 | 2.2 |
| | day 3 | 10.9 | 202 | 1.9 |

TABLE 9-continued

|  |  | WBC | Platelets | Lymphocyte # |
|---|---|---|---|---|
| treatment) | day 5 | 6.4 | 266 | 2.4 |
|  | day 8 | 18.5 | 306 | 3.6 |
| Animal #4 | day 0 | 9.7 | 398 | 7.3 |
| (untreated) | day 3 | 8.4 | 448 | 4.4 |
|  | day 5 | 6.2 | 263 | 1.9 |
|  | day 8 | 2.8 | 143 | 1.5 |

NP Chimeric sequence (SEQ ID NO: 1043):
GGTACCCTCGAGGAGGAAGATTAATAATTTTCCTCTCATTGAAATTTATA
TCGGAATTTAAATTGAAATTGTTACTGTAATCACACCTGGTTTGTTTCAG
AGCCACATCACAAAGATAGAGAACAACCTAGGTCTCCGAAGGGAGCAAGG
GCATCAGTGTGCTCAGTTGAAAATCCCTTGTCAACACCTAGGTCTTATCA
CATCACAAGTTCCACCTCAGACTCTGCAGGGTGATCCAACAACCTTAATA
GAAACATTATTGTTAAAGGACAGCATTAGTTCACAGTCAAACAAGCAAGA
TTGAGAATTAACCTTGGTTTTGAACTTGAACACTTAGGGGATTGAAGATT
CAACAACCCTAAAGCTTGGGGTAAAACATTGGAAATAGTTAAAAGACAAA
TTGCTCGGGTTTACCTGAGAGCCTACAACATGGATAAACGGGTGAGAGGT
TCATTGGCGCCGAGTCTCACTGAATCTGACATGGATTACCACAAGATCTT
GACAGCAGGTCTGTCCGTTCAACAGGGGATTGTTCGGCAAAGAGTCATCC
CAGTGTATCAAGTAAACAATCTTGAAGAAATTTGCCAACTTATCATACAG
GCCTTTGAAGCAGGTGTTGATTTTCAAGAGAGTGCGGACAGTTTCCTTCT
CATGCTTTGTCTTCATCATGCGTACCAGGGAGATTACAAACTTTTCTTGG
AAAGTGGCGCAGTCAAGTATTTGGAAGGGCACGGGTTCCGTTTTGAAGTC
AAGAAGCGTGATGGAGTGAAGCGCCTTGAGGAATTGCTGCCAGCAGTATC
TAGTGGAAAAAACATTAAGAGAACACTTGCTGCCATGCCGGAAGAGGAGA
CAACTGAAGCTAATGCCGGTCAGTTTCTCTCCTTTGCAAGTCTATTTCTA
CCCAAACTTGTCGTTGGAGAAAAGGCTTGCCTTGAGAAGGTTCAAAGGCA
AATTCAAGTACATGCAGAGCAAGGACTGATACAATATCCAACAGCTTGGC
AATCAGTAGGACACATGATGGTGATTTTCCGTTTGATGCGAACAAATTTT
CTGATCAAATTTCTCCTAATACACCAAGGGATGCACATGGTTGCCGGGCA
TGATGCCAACGATGCTGTGATTTCAAATTCAGTGGCTCAAGCTCGTTTTT
CAGGCTTATTGATTGTCAAAACAGTACTTGATCATATCCTACAAAAGACA
GAACGAGGAGTTCGTCTCCATCCTCTTGCAAGGACCGCCAAGGTAAAAAA
TGAGGTGAACTCCTTTAAGGCTGCACTCAGCTCCCTGGCCAAGCATGGAG
AGTATGCTCCTTTCGCCCGACTTTTGAACCTTTCTGGAGTAAATAATCTT
GAGCATGGTCTTTTCCCTCAACTATCGGCAATTGCACTCGGAGTCGCCAC
AGCACACGGGAGTACCCTCGCAGGAGTAAATGTTGGAGAACAGTATCAAC
AACTCAGAGAGGCTGCCACTGAGGCTGAGAAGCAACTCCAACAATACGCA
GAGTCTCGCGAACTTGACCATCTTGGACTTGATGATCAGGAAAAGAAAAT
TCTTATGAACTTCCATCAGAAAAAGAACGAAATCAGCTTCCAGCAAACAA
ACGCTATGGTAACTCTAAGAAAAGAGCGCCTGGCCAAGCTGACAGAAGCT ATCACTGCTGCGTCACTGCCCAAAACAAGTGGACATTACGATGATGATGA
CGACATTCCATTTGCCGGGCCGATCTATGATGACGACAATCCTGGCCATC
AAGATGATGATCCGACTGACTCACAGGATACGACCATTCCCGATGGTGTT
GTTGACCCGTATGATGGAAGCTACGGCGAATATCCTGACTACGAGGATTC
GGCTGAAGGTGCACCAGATGACTTGGTCCTATTCGATCTAGACGAGGACG
ACGAGGACACTAAGCCAGTGCCTAATAGATCGACCAAGGGTGGACAACAG
AAGAACAGTCAAAAGGGCCAGCATATAGAGGGCAGACAGATCCGACCTTG
GACGGAGCGAAAAAGGTGCCGGAGTTGCAGAACAATCCACCACGCCAGTG
CGCCACTCACGGACAATGACAGAAGAAATGAACCCTCCGGCTCAACCAGC
CCTCGCATGCTGACACCAATTAACGAAGAGGCAGACCCACTGGACGATGC
CGACGACGAGAGTCTCACATCCCTGCCCTTGGAGTCAGATGATGAAGAGC
AGGACAGGGACGGAACTTCCAACCGCACACCCACTGTCGCCCCACCGGCT
CCCGTATACAGAGATCACTCTGAAAAGAAAGAACTCCCGCAAGACGAGCA
ACAAGATCAGCACCACACTCAAGAGGCCAGGAACCAGGACAGTGACAACA
CCCAGTCAGAACACTCTTTTGAGGAGATGTATCGCCACATTCTAAGATCA
CAGGGGCCATTTGATGCTGTTTTGTATTATCACCTAATGAGTGATGAGCC
TGTAGTTTTCAGTACCAGTGATGGCAAAGAGTACACGTATCCAGACTCCC
TTGAAGAGGAATATCCACCATGGCTCACTGAAAAAGAGGCTATGAATGAA
GAGAATAGATTTGTTACATTGGATGGTCAACAATTTTATTGGCCGGTGAT
GAATCACAAGAATAAATTCATGGCAATCCTGCAACATCATCAGTGAATGA
GCATGGAACAATGGGATGATTCAACCGACAAATAGCTAACATTAAGTAGT
CAAGGAACGAAAACAGGAAGAATTTTTGATGTCTAAGGTGTGAATTATTA
TCACAATAAAAGTGATTCTTATTTTTGAATTTAAAGCTAGCTTATTATTA
CTAGCCGTTTTTCAAAGTTCAATTTGAGTCTTAATGCAAATAGGCGTTAA
GCCACAGTTATAGCCATAATTGTAACTCAATATTCTAACTAGCGATTTAT
CTAAATTAAATTACATTATGCTTTTATAACTTACCTACTAGCCTGCCCAA
CATTTACACGATCGTTTTATAATTAAGAAAAAGCGGCCGCAGAGCTC GP Chimeric sequence (SEQ ID NO: 1044):
GGTACCCTCGAGGATGAAGATTAAGCCGACAGTGAGCGTAATCTTCATCT
CTCTTAGATTATTTGTTTTCCAGAGTAGGGGTCGTCAGGTCCTTTTCAAT
CGTGTAACCAAATAAACTCCACTAGAAGGATATTGTGGGGCAACAACAC
AATGGGCGTTCTTAGCCTACTCCAATTGCCTCGTGATCGATTCAAGAGGA
CATCATTCTTTCTTTGGGTAATTATCCTTTTCCAAAGAACATTTTCCATC
CCACTTGGAGTCATCCACAATAGCACATTACAGGTTAGTGAGATTGACCA
GCTAGTCTGCAAGGATCATACTGATATGCCATCTGCAACTAAAAGATGGG
GCTTCAGGTCCGGTGTCCCACCAAAGGTGGTCAATTATGAAGCTGGTGAA
TGGGCTGAAAACTGCTACAATCTTGAAATCAAAAAACCGGACGGGAGCGA
ATGCTTACCCGCAGCGCCAGACGGGATTCGGGGCTTCCCCCGGTGCCGGT -continued

```
ATGTGCACAAAGTATCAGGAACGGGACCGTGTGCCGGAGACTTTGCCTTC
CATAAAGAGGGTGCTTTCTTCCTGTATGATCGACTTGCTTCCACAGTTAT
CTACCGAGGAACGACTTTCGCTGAAGGTGTGCTTGCATTTCTGATACTGC
CCCAAGCTAAGAAGGACTTCTTCAGCTCACACCCCTTGAGAGAGCCGGTC
AATGCAACGGAGGACCCGTCTAGTGGCTACTATTCTACCACAATTAGATA
TCAGGCTACCGGTTTTGGAACCAATGAGACAGAGTACTTGTTCGAGGTTG
ACAATTTGACCTACGTCCAACTTGAATCAAGATTCACACCACAGTTTCTG
CTCCAGCTGAATGAGACAATATATACAAGTGGGAAAAGGAGCAATACCAC
GGGAAAACTAATTTGGAAGGTCAACCCCGAAATTGATACAACAATCGGGG
AGTGGGCCTTCTGGGAAACTAAAAAAACCTCACTAGAAAAATTCGCAGTG
AAGAGTTGTCTTTCACAGTTTTATCGCTCAACGAGACAGACATCAGTGGT
CAGAGTCCGGCGCGAACTTCTTCCGGAAGAATCTCCGACCGGGCCACTGA
AGACCACAAAATCATGGCTTCAGAAAATTCCTCTGCAATGGTTCAAGTGC
ACAGTCAAGGAAGGGAAACAACATTGCCGTCTCAGAATTCGACAGAAGGT
CGAAGAGCGAGTCCCCAATCCCTCACAACCAAACCAGGTCCGGACAACAG
CACCCATAATACACCCGTGTATAAACTTGACATCTCTGAGGCAACTCAAG
TTGAACAACATCACCGCAGAACAGACAACGACAGCACAGCCTCCGACACT
CCCTCTGCCACGACCGCAGCCGGACCCCCAAAAGCAGAGAACACCAACAC
GAGCAAGAGCACTGACTTCCTGGACCCCGCCACCACAACAAGTCCCCAAA
ACCACAGCGAGACCGCTGGCAACAACAACACTCATCACCAAGATACCGGA
GAAGAGAGTGCCAGCAGCGGGAAGCTAGGCTTAATTACCAATACTATTGC
TGGAGTCGCAGGACTGATCACAGGCGGGAGAAGAACTCGAAGAGAAGCAA
TTGTCAATGCTCAACCCAAATGCAACCCTAATTTACATTACTGGACTACT
CAGGATGAAGGTGCTGCAATCGGACTGGCCTGGATACCATATTTCGGGCC
AGCAGCCGAGGGAATTTACATAGAGGGGCTAATGCACAATCAAGATGGTT
TAATCTGTGGGTTGAGACAGCTGGCCAACGAGACGACTCAAGCTCTTCAA
CTGTTCCTGAGAGCCACAACGGAGCTGCGACATATACCATACTCAACCG
TAAGGCAATTGATTTCTTGCTGCAGCGATGGGCGGCACATGCCACATTC
TGGGACCGGACTGCTGTATCGAACCACATGATTGGACCAAGAACATAACA
GACAAAATTGATCAGATTATTCATGATTTGTTGATAAAACCCTTCCGGA
CCAGGGGACAATGACAATTGGTGGACAGGATGGAGACAATGGATACCGG
CAGGTATTGGAGTTACAGGCGTTATAATTGCAGTTATCGCTTTATTCTGT
ATATGCAAATTTGTCTTTTAGTTTTTCTTCAGATTGCTTCATGGAAAAGC
TCAGCCTCAAATCAATGAAACCAGGATTTAATTATATGGATTACTTGAAT
CTAAGATTACTTGACAAATGATAATATAATACACTGGAGCTTTAAACATA
GCCAATGTGATTCTAACTCCTTTAAACTCACAGTTAATCATAAACAAGGT
TTGACATCAATCTAGTTATCTCTTTGAGAATGATAAACTTGATGAAGATT
AAGAAAAAGCGGCCGCAGAGCTC
```

The L gene was generated as 2 fragments (L-ABC, SEQ ID NO:1049; and L-DEFG, SEQ ID NO:1050).

L fragment 1: SEQ ID NO: 1049 (L-ABC):
```
GGCGCGCCTCGAGGAGGAAGATTAAGAAAAACTGCTTATTGGGTCTTTCC
GTGTTTTAGATGAAGCAGTTGAAATTCTTCCTCTTGATATTAAATGGCTA
CCCAACATACACAATACCCAGACGCTAGTTATCATCACCAATTGTATTGG
ACCAATGTGACCTAGTCACTAGAGCTTGCGGGTTATATTCATCATACTCC
CTTAATCCGCAACTACGCAACTGTAAACTCCCGAAACATATCTACCGTTT
GAAATACGTGTAACTGTTACCAAGTTCTTGAGTGATGTACCAGTGGCGAC
ATTGCCCATAGATTTCATAGTCCCAGTTCTTCTCAAGGCAATGTCAGGCA
ATGGATTCTGTCCTGTTGAGCCGCGGTGCCAACAGTTCTAGATGAAATCA
TTAAGTACACAATGCAAGATGCTCTCTTCTTGAAATATTATCTCAAAAAT
GTGGGTGCTCAAGAAGACTGTGTTGATGAACACTTTCAAGAGAAATCTT
ATCTTCAATTCAGGGCAATGATTTTTACATCAAATGTTTTTCTGGTATGA
TCTGGCTATTTTAACTCGAAGGGGTAGATTAAATCGAGGAAACTCTAGAT
CAACATGGTTTGTTCATGATGATTTAATAGACATCTTAGGCTATGGGGAC
TTGTTTTTTGGAAGATCCCAATTTCAATGTTACCACTGAACACACAAGGA
ATCCCCCATGCTGCTATGGACTGGTATCAGGCATCAGTATTCAAAGAAGC
GGTTCAAGGGCATACACACATTGTTTCTGTTTTACTGCCGACGTCTTGAT
AATGTGCAAAGATTTAATTACATGTCGATTCAACACAACTCTAATCTCAA
AAATAGCAGAGATTGAGGATCCAGTTTGTTCTGATTATCCCAATTTTAAG
ATTGTGTCTATGCTTACCAGAGCGGAGATTACTTACTCTCCATATTAGGG
TCTGATGGGTATAAAATTATTAAGTTCCTCGAACCATTGTGCTTGGCCAA
AATTCAATTATGCTCAAAGTACACTGAACGAAAAGGGCGGTTTTAACACA
AATGCATTTAGCTGTAAATCACACCCTAGAAGAAATTACAGAAATGCGTG
CACTAAAGCCTTCACAGGCTCAAAAGATCCGTGAATTCCATAGAACATTG
ATAAGGCTGGAGATGACGCCACAACACTTTGTGAGCTATTTTCCATTCAA
AAACACTGGGGCATCCTGTGCTACATAGTGAAACAGCAATCCAAAAAGT
TAAAAAACATGCTACGGTGCTAAAAGCATTACGCCCTATAGTGATTTTCG
AGACATCTGTGTTTTTAAATATAGTATTGCCAAACATTATTTTGATAGTC
AAGGATCTTGGTACAGTGTTACTTCAGACCGATGTTTAACGCCGGGATTG
AATTCTTATATCAAAAGAAATCAATTCCCTCCGTTGCAATGATTAAAGAA
CTACTATGGGAATTTTACCACCTTGACCACCCTCCACTTTTCTCAACCAA
AATTATTAGTGACTTAAGTATTTTTATAAAAGACAGAGCTACCGCAGTAG
AAAGGACATGCTGGGATGAGTATTCGAGCCTAATGTTCTAGGATATAATC
CACCTCACAAATTTAGTACTAAACGTGTACCGGAACAATTTTTAGAGCAA
GAAAACTTTTCTATTGAGAATGTTCTTTCATACGCCCAAGAACTTAGGTT
CTACTACCACAATATCGGAACTTTTCTTTCTCATTGAAAGAGAAAGAGTT
GAATGTAGGTAGAACCTTCGGAAAATTGCCTTATCCGACTCGCAATGTTC
AAACACTTTGTGAAGCTCTGTTAGCTGATGTCTTGCTAAAGCATTTCCTA
GCAATATGATGGTAGTTACGGAACGTGAGCAAAAAGAAAGCTTATTGCAT
```

-continued

CAAGCATCATGGCACCACACAAGTGATGATTTTGGTGAACATGCCACAGT

TAGAGGGAGTACTTTGTAACTGATTTAGAGAAATACAATCTTGCATTTAG

ATATGAGTTTACAGCACCTTTTATAGAATATTGCAACCGTTCCTATGGTG

TTAAGAATGTTTTTAATTGGATGCATTATACAATCCCACAGTTTATATGC

ATGTCAGTGATTATTATAATCCACCACATAACCTCACACTGGAGAATCGA

GACAACCCCCCGAAGGGCCTAGTTCATACAGGGGTCATATGGGAGGGAT

TGAAGGACTGCAACAAAAACTCTGACAAGTATTTCATGTGCTCAAATTTC

TTTAGTTGAAATTAAGACTGGTTTTAAGTTACGCTCAGCTGTGATGGGTG

ACAATCAGTGCATTACTGTTTTATCAGTCTTCCCCTTAGAGACTGACGCA

GACGGCAGGAACAGAGCGCCGAAGACAATGCAGCGAGGGTGGCCGCCAGC

CTAGCAAAAGTTACAAGTGCCTGTGGAATCTTTTTAAAACCTGATGAGAC

TTTCGTACACTCAGGTTTTATCTATTTTGGAAAAAACAATATTTGAATGG

GGTCCAATTGCCTCAGTCCCTTAAAACGGCTACAAGAATGGCACCATTGT

CTGATGCAATTTTTGATGATCTTCAAGGGACCCTGGCTAGTATAGGCACT

GCTTTTGAGCGATCAACTCCGAAACTAGACATATCTTTCCTTGCAGGATA

ACCGCAGCTTTCCATACGTTTTTTTCGGTGAGAATCTTGCAATATCATCA

TCTCGGGTTCAATAAAGGTTTTGACCTTGGACAGTTAACACTCGGCAACC

TCTGGATTTCGGAACAATATCATTGGCACTAGCGGTACCGCAGGTGCTTG

GAGGGTTATCCTTCTTGAATCCTGAGAAATGTTTCTACCGGAATCTAGGA

GATCCAGTTACCTCAGGCTTATTCCAGTAAAAACTTATCTCCGAATAGAG

ACCTATTGAGCTCCACCGCGGTGGCGGCCGCTCTAGCCCGGGCGGATCCC

CCGGGCTGCAGGAATTCGATATCAAGCTTATCGATACCGTCGACCTCGAG

GGGGGGCCCGTACCTTACATCGCGTTAATTAACTAGTGGATCGATCCCCA

ATTCG

L fragment 2: SEQ ID NO: 1050 (L-DEFG):
CGCGACGTAATACGACTCACTATAGGGCGAATGGGCGCGCCCCGTCTCA

GAATGATTGAGATGGATGATTTATTCTTACCTTTAATTGCGAAGAACCCT

GGGAATTGTAGCGCAATTGACTTTGTGTAAATCCTAGCGGATTAAATGTC

CCTGGGTCGCAAGACTTAACTTCATTTCTGCGCCAGATTGTACGCAGGAC

CATCACCCTAAGTGCGAAAAACAAACTTATTAATACCTTATTTCATGCGT

CAGCTGACTCGAAGACGAAATGGTTTGTAAATGGCTATTATCATCAACTC

CTGTTATGAGTCGTTTTGCGGCCGATATCTTTTCACGCACGCCGAGCGGG

AAGCGATTGCAAATTCTAGGATACCTGGAAGGAACACGCCATTATTAGCC

TCTAAGATCATCAACAATAATACAGAGACACCGGTTTTGCACAGACTGAG

GAAAATAACATTGCAAAGGTGGAGCCTATGGTTTAGTTATCTTGATCATT

GTGATAAATATCCTGGCGGAGCTTTAACCCAAATAACTTGCACAGTTGATT

TAGCACAGATTCTGAGGGAATATTCATGGGCTCATATTTTAGAGGGAAGA

CCTCTTATTGGAGCCACACTCCCATGTATGATTGAGCAATTCAAAGTGTT

TGGCTGAAACCCTACGAACAATGTCCGCAGTGTTCAAATGCAAAGCAACC

AGGTGGGAAACCATTCGTGTCAGTGGCAGTCAAGAAACATATTGTTAGTG

CATGGCCGAACGCATCCCGAATAAGCTGGACTTCGGGGATGGAATCCCAT

-continued

ACATTGGATCAAGGACAGAAGATAAGATAGGTCAGCCCGCTATTAAGCCG

AGGTGTCCTTCCGCAGCCTTAAGAGAGGCCATTGAATTGGCGTCCCGTTT

AACATGGGTAACTAAGGCAGTTCGAACAGTGACTTGCTAATAAAACCATT

TTTGGAAGCACGAGTAAATTTAAGTGTTCAAGAAATACTTCAAATGACCC

CTTCACATTACTCAGGAAATATTGTGCATCGGTATAACGATCAAACAGTC

CTCATTCTTTCATGGCCAATCGTATGAGTAATTCAGCAACGCGCTTGATG

GTATCTACAAACACTTTAGGTGAGTTTTCAGGAGGTGGCCAGTCTGCACG

CGACAGCAATATTATTTTCCAGAATTTATAAATTATGCAGTTGCACTGTT

CGATATTAAATTTAGAAACACTGAGGCTACAGATATCCAATATAATCGTG

CTCACCTTCATCTAACTAAGTGTTGCACCCGGGAAGTACCAGCTCAGTAT

TTAACAACACAACCACGCTAAATCTAGATTTAACAAGATACCGAGAAAAC

GAATTGATTTATGACAGTAATCCTCTAAAAGGAGGACTCAATTGCAACTT

ATCGATTGACAGTCCTTTTTTTCCAAGGTAAACGGCTGACATTATAGAAGA

TGATCTTATTCGACTGCCTCACTTATCTGGATGGGAGCTAGCCAAGACCA

TCATGCAATCAATTATTTCAGATAGCAACAATTCATCTACAGACCCAATT

AGCAGTGGAGAAACAAGACATTCACTACCCATTTCTTAACTTATCCCAAG

ATAGGACTTCTGTACAGTTTTGGGGCCTTTGTAAGTTATTATCTTGGCAA

TACAATTCTTTGCACGAAAAAGATCGGACTTGACAATTTTTTATATTACT

AACTACTCAAATTCATAATCTACCACATCGCTCATTGCGAATACTTAAGC

CAACATTCAAACATGCAAGCGTTATGTCACGGTTAATGAGTATTGATCCT

CATTTTTCTATTTACATAGGCGGTGCTGCAGTGACAGAGGACTCTCAGAT

GCGGCCAGGTTATTTTTGAGAACGTCCATTTCATCTTTTCTTACATTTGT

AAAAGAATGGATAATTAATCGCGGAACAATTGTCCCTTTATGGATAGTAT

ATCCGCTAGAGGTCAAAACCCAACACCTGTGAATAATTTTCTCTATCAGA

TCGTAGAACTGCTGGTGCATGATTCATCAAGACAACAGGCTTTTAAAACT

ACCATAAGTGATCATGTACATCCTCACGACAATCTTGTTTACCATGTAAG

AGTACAGCCAGCAATTTCTTCCATGCATCATTGGCGTACTGGAGGAGCAG

ACACAGAAACAGCAACCGAAAATACTTGGCAAGAGACTCTTCAACTGGAT

CAAGCACAAACAACAGTGATGGTATATTGAGAGAAGTCAAGAACAAACCA

CCAGAGATCCACATGATGGCACTGAACGAATCTAGTCCTACAAATGAGC

CATGAAATAAAAGAACGACAATTCCACAAGAAAACACGCACCAGGGTCC

GTCGTCCAGTCCTTTGTAAGTGACTCTGCTTGTGGTACAGCAAATCCAAA

ACTAAATTTCGATCGATCGAGACACAATGTGAAATTTCAGGATCATAACT

CGGCATCCAAGAGGGAAGGTCATCAAATAATCTCAACCGTCTAGTCCTAC

CTTTCTTTACATTATCTCAAGGGACACGCCAATTAACGTCATCCAATGAG

TCACAAACCCAAGACGAGATATCAAAGTACTTACGGCAATTGAGATCCGT

CATTGATACTACCATAATTGTCGCTTCACCGGTATAGTCTCGTCCATGCA

TTACAAACTTGATGAGGTCCTTTGGGAAATAGAGAGTTTCAAGTCGGCTG

TGACGCTAGCAGAGGGAGAAGGTGCTGGTGCCTTACTATTGATTCAAAAT

ACGGCGTTAAGAAGTTATTTTTCAACACGCTAGCTACTGAGTCCAGTATA

-continued

GAGTCAGAAATAGTATCAGGAATGACTACTCCTAGGATGCTTCTACCTGT

TATGTCAAAATTCCATAATGACCAAATTAGATTATTCTTAACAACTCAGC

AAGCCAAATAACAGACATAACAAATCCTACTTGGTTTAAAGACCAAAGAG

CAAGGCTACCTAAGCAAGTCGAGGTTATAACCATGGATGCAGAGACAACA

GAGAATATAACAGATCGAAATTGTACGAAGCTGTATATAAATTGATCTTA

CACCATATTGATCCTAGCGTATTGAAAGCAGTGGTCCTTAAAGTCTTTCT

AAGTGATACTGAGGGTATGTTATGGCTAAATGATAATTTACCCCGTTTTT

TGCCACTGGTTATTTAATTAAGCCAATAACGTCAAGTGCTAGATCTAGTG

AGTGGTATCTTTGTCTGACGAACTTCTTATCAACTACACGTAAGATGCCA

CACCAAAACCATCTCAGTTGTAACAGGTAATACTTACGGCATTGCAACTG

CAAATTCAACCAAGCCCATACTGGCTAAGTCATTTAACTCAGTATGCTGA

CTGTGAGTTACATTTAAGTTATATCCGCCTTGGTTTTCCATCATTAGAGA

AATACTATACCACAGGTATAAACCTCGTCGATTCAAAAAGAGGTCCACTAG

TCTCTATCACTCAGCACTTAGCACATCTTAGAGCAGAGATTCGAGAATTA

ACTAATGATTATAATCAACAGCGACAAAGTCGACCCAGACTTATCATTTT

ATTCGTACTGCAAAAGGACGGATAACTAAACTAGTCAATGATTATTTAAA

ATTCTTTCTTATTGTGCAAGCATTAAAACATAATGGGACATGGCAAGCTG

AGTTTAAGAAATTACAGAGTTGATTAGTGTGTGCAATAGGTTCTACCATA

TTAGAGATTGCAATTGTGAAGAACGTTTCTTAGTTCAAACCTTATATTTA

CATAGAATGCAGGATTCTGAAGTTAAGCTTATCGAAAGGCTGACAGGCTT

CTGAGTTTATTTCCGGATGGTCTCTACAGGTTTGATTGAATTACCGTGCA

TAGTATCCTGATACTTGCAAAGGTTGGTTATTAACATACAGATTATAAAA

AAGCGGCCGCAGAGCTCCAGCGGTGGGGCCGCCGGCGTCTAGCCCGGGCG

GATCCCTGCAGGAATTCGATATCAAGCTTATCGATACCGTCGACCTCGAG

GGCCCATGCAGGCCGGCCAGGTACCTTAGTTAATTAACAGCTTTTGTTCC

CTTTAGTAGGGTTAATTGACGCGCTC

VP24 (SEQ ID NO: 1045):
GGCGCGCCTCGAGGATGAAGATTAATGCGGAGGTCTGATAAGAATAAACC

TTATTATTCAGATTAGGCCCCAAGAGGCATTCTTCATCTCCTTTTAGCAA

AGTACTATTTCAGGGTAGTCCAATTAGTGGCACGTCTTTTAGCTGTATAT

CAGTCGCCCCTAGGCTAGGGTTTATAGTTGTCTCTAAGCTAAATTGGTCT

TGAACTAGTCTACTCGCAGAATCCTACCGGGAATAGACTAATTGAACTTA

GCCGTTTAAAATTTAGTGCATAAATCTGGGCTAACACCACCAGGTCAACT

CCATTGGCTGAAAAGAAGCTTACCTACAACGAACATCACTTTGAGCGCCC

TCACAATTAAAAATAGGAACGTCGTTCCAACAATCGAGCGCAAGGTTTC

AATATTATACGGGTCCATTAATTTCAACAAAATATTGATACTCCAGACAC

CAAGCAAGACCTGAGAAAAACCATGGCTAAAGCTACGGGACGATACAAT

CTAATATCGCCCAAAAAGGACCTGGAGAAAGGGGTTGTCTTAAGCGACCT

CTGTAACTTCTTAGTTAGCCAAACTATTCAGGGGTGGAAGGTTTATTGGG

CTGGTATTGAGTTTGATGTGAACCAAAAGGGTATTACCCTATTGCATAGA

-continued

CTGAAAACTAATGACTTTGCCCCTGCATGGTCAATGACAAGGAATCTCTT

TCCTCATTTATTTCAAAATCCGAATTCCACAATTGAATCACCGCTGTGGG

CATTGAGAGTCATCCTTGCAGCAGGGATACAGGACCAGCTGATTGACCAG

TCTTTGATTGAACCCTTAGCAGGAGCCCTTGGTCTGATCTCTGATTGGCT

GCTAACAACCAACACTAACCATTTCAACATGCGAACACAACGTGTCAAGG

AACAATTGAGCCTAAAAATGCTGTCGTTGATTCGATCCAATATTCTCAAG

TTTATTAACAAATTGGATGCTCTACATGTCGTGAACTACAACGGATTGTT

GAGCAGTATTGAAATTGGAACTCAAAATCATACAATCATCATAACTCGGA

CTAATATGGGTTATCTTGTCGAGCTCCAAGAACCCGACAAATCTGCGATG

GATATACGACACCCTGGGCCGGCGAAATTTTCCTTACTACATGAATCGAC

ACTTAAAGCATTTACACAAGGATCCTCGACACGAATGCAAAGTTTGATTC

TTGAATTTAATAGCTCTCTTGCTATCTAACTAAGGTAGAAAAAATTGTAC

GATAGGGCTAACATTATGCTGACTCAATAGTTATCTTGACATCTCTGCTT

TCATAATCAGATATATAAGCATAATAAATAAATACTCATATTTCTTGATA

ATTTGTTTAACCACAGATAAATCCTCACTGTAAGCCAGCTTCCAAGTTGA

CACCCTTACAAAAACCAGGACTCAGAATCCCTCAAACAAGAGATTCCAAG

ACAACATCATAGAATTGCTTTATTATATGAATAAGCATTTTATCACCAGA

AATCCTATATACTAAATGGTTAATTGTAACTGAACCCGCAGGTCACATGT

GTTAGGTTTCACAGATTCTATATATTACTAACTCTAGAGCCCAAATTAAC

ACGGTATAAGTAGATTAAGAAAAAAGCCTGAGGAAGATTAAGAAAAAGCG

GCCGCATTAATTAA

VP30 (SEQ ID NO: 1046):
GGCGCGCCTCGAGGATGAAGATTAAGAAAAAGGTAATCTTTCGATTATCT

TTAATCTTCATCCTTGATTCTACAATCATGACAGTTGTCTTTAGTGACAA

GGGAAAGAAGCCTTTTTATTAAGTTGTAATAATCAGATCTGCGAACCGGT

AGAGTTTAGTTGCAACCTAACACACATAAAGCATTGGTCAAAAAGTCAAT

AGAAATTTAAACAGTGAGTGGAGACAACTTTTAAATGGAAGCTTCGTGAG

CGCGGGAGATCAAGGAATTCACGTGCCGACCAGCAAGGGATGGACACGAC

CACCATGTTCGAGCACGATCATCATCCAGAGAGAATTATCGAGGTGAGTA

CCGTCAATCAAGGAGCGCCTCACAAGTGCGCGTTCCTACTGTATTTCATA

AGAAGAGAGTTGAACCATTAACAGTTCCTCCAGCACCTAAAGACATATGT

CCGACCTTGAAAAAAGGATTTTTGTGTGACAGTAGTTTTTGCAAAAAAGA

TCACCAGCTTGAAAGCCTAACCGACCGGGAATTACTCCTACTAATCGCCC

GTAAGACTTGTGGATCAGTTGATTCATCGCTTAATATAACTGCACCCAAG

GACTCGCGCTTAGCAAATCCAACGGCTGATGATTTCCAGCAAGAGGAAGG

TCCAAAAAATTACTAGTCGAGACTGCTCAAGACGGCAGAACACTGGGCGA

GACAAGACATCAGAACCATAGAGGATTCAAAATTAAGAGCATTGTTGACT

CTATGTGCTGTGATGACGAGGAAATTCTCAAAATCCCAGCTGAGTCTTTT

ATGTGAGACACACCTAAGGCGCGAGGGGCTTGGGCAAGATCAGGCAGAAC

CCGTTCTCGAAGTATATCAACGATTACACAGTGATAAAGGAGGCAGTTTT

GAAGCTGCACTATGGCAACAATGGGACCGACAATCCCTAATTATGTTTAT

CACTGCATTCTTGAATATTGCTCTCCAGTTACCGTGTGAAAGTTCTGCTG

TCGTTGTTTCAGGCCTACGCTTACTTGCCCCCCCAAGCGTTAATGAAGAA

GCTTCAACCAACCCGGGGACATGCTCATGGTCTGATGAGGGTACCCCTTA

ATAAGGCTGACTAAAACACTATATAACCTTCTACTTGATCACAATACTCC

GTATACCTATCATCATATATTTAATCAAGACGATATCCTTTAAAACTTAT

TCAGTACTATAATCACTCTCGTTTCAAATTAATAAGATGTGCATGATTGC

CCTAATATATGAAGAGGTATGATACAACCCTAACAGTGATCAAAGAAAAT

CATAATCTCGTATCGCTCGTAATATAACCTGCCAAGCATACTCCCTAGAA

GCGTTGAATCTTGTACACAAATAATGTTTTACTCTACAGGAGGTAGCAAC

GATCCATCCCATCAAAAAATAAGTATTTCATGACTTACTAATGATCTCTT

AAAATATTAAGAAAAAGCGGCCGCATTAATTAA

VP35 (SEQ ID NO: 1047):
GGTACCGCGATCGCGATGAAGATTAAAACCTTCATCATCCTTACGTCAAT
TGAATTCTCTAGCACTCGAAGCTTATTGTCTTCAATGTAAAAGAAAAGCT
GGTCTAACAAGATGACAACTAGAACAAAGGGCAGGGGCCATACTGCGGCC
ACGACTCAAAACGACAGAATGCCAGGCCCTGAGCTTTCGGGCTGGATCTC
TGAGCAGCTAATGACCGGCAAAATACCGCTAACCGACATCTTCTGTGATA
TTGAGAACAATCCAGGATTATGCTACGCATCCCAAATGCAACAAACGAAG
CCAAACCCGAAGACGCGCAACAGTCAAACCCAAACGGACCCAATTTGCAA
TCATAGTTTTGAGGAGGTAGTACAAACATTGGCTTCATTGGCTACAGCTG
TGCGTCGGCAAACCATCGCATCAGAATCATTAGAACAACGCATTACGAGT
CTTGAGAATGGTCTAAAGCCAGTTTATGATATGGCAAAAACAATATCATC
CCTGAATCGCAGCTGTGCTGAGATGGTTGCAAAATATGATCTTCTGGTGA
TGACAACCGGTCGGGCAACAGCAACCGCTGCGGCAACTGAGGCTTATTGG
GCCGAACATGGTCAACCACCACCAGGCCCATCATTGTACGAGGATGGTGC
GATTCGGGGTAAATTGAAAGATCCGAACGGGACCGTCCCTCAAAGTGTTA
GGGAGGCATTCAACAATCTAAACAGTACCACTTCACTAACTGAGGAAAAT
TTCGGGCGACCTTACATTTCGGCAAAGGATTTGAGAAACATTATGTATGA
TCACTTGCCTGGTTTTGGAACTGCTTTCCACCAATTAGTACAAGTGATTT
GTAAATTGGGAAAAGATAGCAACTCATTGGACATCATTCATGCTGAGTTC
CAGGCCAGCCTGGCTGAAGGAGACTCTCCTCAATGTGCCCTAATTCAAAT
TACAAAAAGAGTTCCAATCTTCCAAGATGCTGCTCCACCTGTCATCCACA
TCCGCTCTCGAGGTGACATTCCCCGAGCTTGCCAGAAAAGCTTGCGTCCA
GTCCCACCATCGCCCAAGATTGATCGAGGTTGGGTATGTGTTTTTCAGCT
TCAAGATGGTAAAACACTTGGACTCAAAATTTGAGCCAATGTAAGCTCAT
TTTGCGATGGGCGAATAATAGCAGAGGCTTCAACTGCTGAACTATAGGGT
ACGTTACATTAATGATACACTTGTGAGTATCAGCCCTGGATAATATAAGT
CAATCCTAATCAATTGATAATATTGTTCATATCTCGCTAGCAGCTTAAAA
TATAAATGTAATAGGAGCTATATCTCTGACAGTATTATAATCAATTGTTA
TTAAGTAACCCAAACCAAAAGTGATGAAGATTAAGAAAAAGCGGCCGCAG

-continued

AGCTC

VP40 (SEQ ID NO: 1048):
GGTACCTCGAGGATGAAGATTAAGAAAAACCTACCTCGGCTGAGAGAGTG
TTTTTTCATTAACCTTCATCTTGTAAACGTTGAGCAAAATTGTTAAAAAT
ATGAGGCGGGTTATATTGCCTACTGCTCCTCCTGAATATATGGAGGCCAT
ATACCCTGTCAGGTCAAATTCAACAATTGCTAGAGGTGGCAACAGCAATA
CAGGCTTCCTGACACCGGAGTCAGTCAATGGGGACACTCCATCGAATCCA
CTCAGGCCAATTGCCGATGACACCATCGACCATGCCAGCCACACACCAGG
CAGTGTGTCATCAGCATTCATCCTTGAAGCTATGGTGAATGTCATATCGG
GCCCCAAAGTGCTAATGAAGCAAATCCCTATTTGGTTGCCTCTAGGTGTC
GCTGATCAAAAGACCTACAGCTTTGACTCAACTACGGCCGCAATTATGCT
CGCATCTTATACGATCACCCATTTCGGCAAGGCAACCAACCCCCTCGTTA
GAGTGAATCGACTGGGTCCTGGAATCCCGGATCATCCCCTCAGGCTCCTG
CGAATTGGAAACCAGGCTTTCCTCCAGGAGTTCGTTCTTCCGCCAGTCCA
ACTACCCCAGTATTTCACCTTTGATTTGACAGCACTCAAACTGATCACCC
AACCACTGCCTGCTGCAACATGGACCGATGACACTCCAACAGGATCAAAT
GGAGCGTTGCGTCCAGGAATTTCATTTCATCCAAAACTTCGCCCCATTCT
TTTACCCAACAAAAGTGGGAAGAAGGGGAACAGTGCCGATCTAACATCTC
CGGAGAAAATCCAAGCAATAATGACTTCACTCCAGGACTTTAAGATCGTG
CCAATTGATCCAGCCAAGAGTATCATTGGGATCGAGGTGCCAGAAACTCT
GGTCCACAAGCTGACCGGTAAGAAGGTGACTTCTAAAAATGGACAACCAA
TCATCCCTGTTCTTTTGCCAAAGTACATTGGGTTGGACCCGGTGGCTCCA
GGAGACCTCACCATGGTAATCACACAGGATTGTGACACGTGTCATTCTCC
TGCAAGTCTTCCAGCTGTGATTGAGAAGTAATTGCAATAATTGACTCAGA
TCCAGTTTTATAGAATCTTCTCAGGGATAGCAACTCAATCGACTTTTAGG
ACCGTCCATTAGAGGAGACACTTTTAATTGAAAAATGTACTAATCGGGTC
AAGGACCATTGTCTTTTTTCTCTCCTAAATGTAGAACTTAACAAAAGACT
CATAATATACTTGTTTTTAAAGGATTGATTGATGAAAGAACATGCATAAG
CGATCCATACTTCGCCCTACTATAATCAATACGGTGATTCAAATGTTAAT
CTTTCTCATTGCACATACTTTTTGCCCTTATCCTCAAATTGCCTGCATGC
TTACATCTGAGGATAGCCAGTGTGACTTGGATTGGAAATGTGGAGAAAAA
ATCGGGACCCATTTCTAGGTTGTTCACAATCCAAGTACAGACATTGCCCT
TCTAATTAAGAAAAAAGCGGCCGCAGAGCTC

Other embodiments are in the claims.

---

SEQUENCE LISTING (1108 sequences)

SEQ ID NO: 1 - DNA, 21 bp, Artificial Sequence
  Description of Artificial Sequence: Synthetic oligonucleotide
  modified_base (21)..(21): 2'-deoxy-thymidine-5'-phosphate-phosphorothioate
gaugaagauuaaaaccuuctt

SEQ ID NO: 2 - DNA, 21 bp, Artificial Sequence
  Description of Artificial Sequence: Synthetic oligonucleotide
  modified_base (21)..(21): 2'-deoxy-thymidine-5'-phosphate-phosphorothioate
gaagguuuuaaucuucauctt

SEQ ID NO: 3 - DNA, 21 bp, Artificial Sequence
  Description of Artificial Sequence: Synthetic oligonucleotide
  modified_base (21)..(21): 2'-deoxy-thymidine-5'-phosphate-phosphorothioate
augaagauuaaaaccuucatt

SEQ ID NO: 4 - DNA, 21 bp, Artificial Sequence
  Description of Artificial Sequence: Synthetic oligonucleotide
  modified_base (21)..(21): 2'-deoxy-thymidine-5'-phosphate-phosphorothioate
ugaagguuuuaaucuucautt

SEQ ID NO: 5 - DNA, 21 bp, Artificial Sequence
  Description of Artificial Sequence: Synthetic oligonucleotide
  modified_base (21)..(21): 2'-deoxy-thymidine-5'-phosphate-phosphorothioate
ugaagauuaaaaccuucautt

SEQ ID NO: 6 - DNA, 21 bp, Artificial Sequence
  Description of Artificial Sequence: Synthetic oligonucleotide
  modified_base (21)..(21): 2'-deoxy-thymidine-5'-phosphate-phosphorothioate
augaagguuuuaaucuucatt

SEQ ID NO: 7 - DNA, 21 bp, Artificial Sequence
  Description of Artificial Sequence: Synthetic oligonucleotide
  modified_base (21)..(21): 2'-deoxy-thymidine-5'-phosphate-phosphorothioate
gaagauuaaaaccuucauctt

SEQ ID NO: 8 - DNA, 21 bp, Artificial Sequence
  Description of Artificial Sequence: Synthetic oligonucleotide
  modified_base (21)..(21): 2'-deoxy-thymidine-5'-phosphate-phosphorothioate
gaugaagguuuuaaucuuctt

SEQ ID NO: 9 - DNA, 21 bp, Artificial Sequence
  Description of Artificial Sequence: Synthetic oligonucleotide
  modified_base (21)..(21): 2'-deoxy-thymidine-5'-phosphate-phosphorothioate
ugaugaagauuaagaaaaatt

SEQ ID NO: 10 - DNA, 21 bp, Artificial Sequence
  Description of Artificial Sequence: Synthetic oligonucleotide
  modified_base (21)..(21): 2'-deoxy-thymidine-5'-phosphate-phosphorothioate
uuuuucuuaaucuucaucatt

SEQ ID NO: 11 - DNA, 21 bp, Artificial Sequence
  Description of Artificial Sequence: Synthetic oligonucleotide
  modified_base (21)..(21): 2'-deoxy-thymidine-5'-phosphate-phosphorothioate
aagauuaaaaccuucaucatt

SEQ ID NO: 12 - DNA, 21 bp, Artificial Sequence
  Description of Artificial Sequence: Synthetic oligonucleotide
  modified_base (21)..(21): 2'-deoxy-thymidine-5'-phosphate-phosphorothioate
ugaugaagguuuuaaucuutt

SEQ ID NO: 13 - DNA, 21 bp, Artificial Sequence
  Description of Artificial Sequence: Synthetic oligonucleotide
  modified_base (21)..(21): 2'-deoxy-thymidine-5'-phosphate-phosphorothioate
agauuaaaaccuucaucautt

SEQ ID NO: 14 - DNA, 21 bp, Artificial Sequence
  Description of Artificial Sequence: Synthetic oligonucleotide
  modified_base (21)..(21): 2'-deoxy-thymidine-5'-phosphate-phosphorothioate
augaugaagguuuuaaucutt

SEQ ID NO: 15 - DNA, 21 bp, Artificial Sequence
  Description of Artificial Sequence: Synthetic oligonucleotide
  modified_base (21)..(21): 2'-deoxy-thymidine-5'-phosphate-phosphorothioate
gauuaaaaccuucaucauctt

SEQ ID NO: 16 - DNA, 21 bp, Artificial Sequence
  Description of Artificial Sequence: Synthetic oligonucleotide
  modified_base (21)..(21): 2'-deoxy-thymidine-5'-phosphate-phosphorothioate
gaugaugaagguuuuaauctt

SEQ ID NO: 17 - DNA, 21 bp, Artificial Sequence
  Description of Artificial Sequence: Synthetic oligonucleotide
  modified_base (21)..(21): 2'-deoxy-thymidine-5'-phosphate-phosphorothioate
auuaaaaccuucaucaucctt

SEQ ID NO: 18 - DNA, 21 bp, Artificial Sequence
  Description of Artificial Sequence: Synthetic oligonucleotide
  modified_base (21)..(21): 2'-deoxy-thymidine-5'-phosphate-phosphorothioate
ggaugaugaagguuuuaautt

SEQ ID NO: 19 - DNA, 21 bp, Artificial Sequence
  Description of Artificial Sequence: Synthetic oligonucleotide
  modified_base (21)..(21): 2'-deoxy-thymidine-5'-phosphate-phosphorothioate
uuaaaaccuucaucauccutt

SEQ ID NO: 20 - DNA, 21 bp, Artificial Sequence
  Description of Artificial Sequence: Synthetic oligonucleotide
  modified_base (21)..(21): 2'-deoxy-thymidine-5'-phosphate-phosphorothioate
aggaugaugaagguuuuaatt

SEQ ID NO: 21 - DNA, 21 bp, Artificial Sequence
  Description of Artificial Sequence: Synthetic oligonucleotide
  modified_base (21)..(21): 2'-deoxy-thymidine-5'-phosphate-phosphorothioate
uaaaaccuucaucauccuutt

SEQ ID NO: 22 - DNA, 21 bp, Artificial Sequence
  Description of Artificial Sequence: Synthetic oligonucleotide
  modified_base (21)..(21): 2'-deoxy-thymidine-5'-phosphate-phosphorothioate
aaggaugaugaagguuuuatt

SEQ ID NO: 23 - DNA, 21 bp, Artificial Sequence
  Description of Artificial Sequence: Synthetic oligonucleotide
  modified_base (21)..(21): 2'-deoxy-thymidine-5'-phosphate-phosphorothioate
gaugaagauuaagaaaaagtt

SEQ ID NO: 24 - DNA, 21 bp, Artificial Sequence
  Description of Artificial Sequence: Synthetic oligonucleotide
  modified_base (21)..(21): 2'-deoxy-thymidine-5'-phosphate-phosphorothioate
cuuuuucuuaaucuucauctt

SEQ ID NO: 25 - DNA, 21 bp, Artificial Sequence
  Description of Artificial Sequence: Synthetic oligonucleotide
  modified_base (21)..(21): 2'-deoxy-thymidine-5'-phosphate-phosphorothioate
uggacacaugauggugauctt

SEQ ID NO: 26 - DNA, 21 bp, Artificial Sequence
  Description of Artificial Sequence: Synthetic oligonucleotide
  modified_base (21)..(21): 2'-deoxy-thymidine-5'-phosphate-phosphorothioate
gaucaccaucauguguccatt

SEQ ID NO: 27 - DNA, 21 bp, Artificial Sequence
  Description of Artificial Sequence: Synthetic oligonucleotide
  modified_base (21)..(21): 2'-deoxy-thymidine-5'-phosphate-phosphorothioate
aagcaacuccaacaauaugtt

SEQ ID NO: 28 - DNA, 21 bp, Artificial Sequence
  Description of Artificial Sequence: Synthetic oligonucleotide
  modified_base (21)..(21): 2'-deoxy-thymidine-5'-phosphate-phosphorothioate
cauauuguuggaguugcuutt

SEQ ID NO: 29 - DNA, 21 bp, Artificial Sequence
  Description of Artificial Sequence: Synthetic oligonucleotide
  modified_base (21)..(21): 2'-deoxy-thymidine-5'-phosphate-phosphorothioate
aaaaccuucaucauccuuutt

SEQ ID NO: 30 - DNA, 21 bp, Artificial Sequence
  Description of Artificial Sequence: Synthetic oligonucleotide
  modified_base (21)..(21): 2'-deoxy-thymidine-5'-phosphate-phosphorothioate
aaaggaugaugaagguuuutt

SEQ ID NO: 31 - DNA, 21 bp, Artificial Sequence
  Description of Artificial Sequence: Synthetic oligonucleotide
  modified_base (21)..(21): 2'-deoxy-thymidine-5'-phosphate-phosphorothioate
uugaugaagauuaagaaaatt

SEQ ID NO: 32 - DNA, 21 bp, Artificial Sequence
  Description of Artificial Sequence: Synthetic oligonucleotide
  modified_base (21)..(21): 2'-deoxy-thymidine-5'-phosphate-phosphorothioate
uuuucuuaaucuucaucaatt

SEQ ID NO: 33 - DNA, 21 bp, Artificial Sequence
  Description of Artificial Sequence: Synthetic oligonucleotide
  modified_base (21)..(21): 2'-deoxy-thymidine-5'-phosphate-phosphorothioate
gaugaagauuaagaaaaagtt

SEQ ID NO: 34 - DNA, 21 bp, Artificial Sequence
  Description of Artificial Sequence: Synthetic oligonucleotide
  modified_base (21)..(21): 2'-deoxy-thymidine-5'-phosphate-phosphorothioate
cuuuuucuuaaucuucauctt

SEQ ID NO: 35 - DNA, 21 bp, Artificial Sequence
  Description of Artificial Sequence: Synthetic oligonucleotide
  modified_base (21)..(21): 2'-deoxy-thymidine-5'-phosphate-phosphorothioate
cccugcugcaacauggacatt

SEQ ID NO: 36 - DNA, 21 bp, Artificial Sequence
  Description of Artificial Sequence: Synthetic oligonucleotide
  modified_base (21)..(21): 2'-deoxy-thymidine-5'-phosphate-phosphorothioate
uguccauguugcagcagggtt

SEQ ID NO: 37 - DNA, 21 bp, Artificial Sequence
  Description of Artificial Sequence: Synthetic oligonucleotide
  modified_base (21)..(21): 2'-deoxy-thymidine-5'-phosphate-phosphorothioate
augaagauuaagaaaaagutt

SEQ ID NO: 38 - DNA, 21 bp, Artificial Sequence
  Description of Artificial Sequence: Synthetic oligonucleotide
  modified_base (21)..(21): 2'-deoxy-thymidine-5'-phosphate-phosphorothioate
acuuuuucuuaaucuucautt

SEQ ID NO: 39 - DNA, 21 bp, Artificial Sequence
  Description of Artificial Sequence: Synthetic oligonucleotide
  modified_base (21)..(21): 2'-deoxy-thymidine-5'-phosphate-phosphorothioate
aagauuaagaaaaaguccatt

SEQ ID NO: 40 - DNA, 21 bp, Artificial Sequence
  Description of Artificial Sequence: Synthetic oligonucleotide
  modified_base (21)..(21): 2'-deoxy-thymidine-5'-phosphate-phosphorothioate
uggacuuuuucuuaaucuutt

SEQ ID NO: 41 - DNA, 21 bp, Artificial Sequence
  Description of Artificial Sequence: Synthetic oligonucleotide
  modified_base (21)..(21): 2'-deoxy-thymidine-5'-phosphate-phosphorothioate
aagauuaauaauuuuccuctt

SEQ ID NO: 42 - DNA, 21 bp, Artificial Sequence
  Description of Artificial Sequence: Synthetic oligonucleotide
  modified_base (21)..(21): 2'-deoxy-thymidine-5'-phosphate-phosphorothioate
gaggaaaauuauuaaucuutt

SEQ ID NO: 43 - DNA, 21 bp, Artificial Sequence
  Description of Artificial Sequence: Synthetic oligonucleotide
  modified_base (21)..(21): 2'-deoxy-thymidine-5'-phosphate-phosphorothioate
augccggaagaggagacaatt

SEQ ID NO: 44 - DNA, 21 bp, Artificial Sequence
  Description of Artificial Sequence: Synthetic oligonucleotide
  modified_base (21)..(21): 2'-deoxy-thymidine-5'-phosphate-phosphorothioate
uugucuccucuuccggcautt

SEQ ID NO: 45 - DNA, 21 bp, Artificial Sequence
  Description of Artificial Sequence: Synthetic oligonucleotide
  modified_base (21)..(21): 2'-deoxy-thymidine-5'-phosphate-phosphorothioate
ugccggaagaggagacaactt

SEQ ID NO: 46 - DNA, 21 bp, Artificial Sequence
  Description of Artificial Sequence: Synthetic oligonucleotide
  modified_base (21)..(21): 2'-deoxy-thymidine-5'-phosphate-phosphorothioate
guugucuccucuuccggcatt

SEQ ID NO: 47 - DNA, 21 bp, Artificial Sequence
  Description of Artificial Sequence: Synthetic oligonucleotide
  modified_base (21)..(21): 2'-deoxy-thymidine-5'-phosphate-phosphorothioate
gcaaucaguaggacacaugtt

SEQ ID NO: 48 - DNA, 21 bp, Artificial Sequence
  Description of Artificial Sequence: Synthetic oligonucleotide
  modified_base (21)..(21): 2'-deoxy-thymidine-5'-phosphate-phosphorothioate
cauguguccuacugauugctt

SEQ ID NO: 49 - DNA, 21 bp, Artificial Sequence
  Description of Artificial Sequence: Synthetic oligonucleotide
  modified_base (21)..(21): 2'-deoxy-thymidine-5'-phosphate-phosphorothioate
caaucaguaggacacaugatt

SEQ ID NO: 50 - DNA, 21 bp, Artificial Sequence
  Description of Artificial Sequence: Synthetic oligonucleotide
  modified_base (21)..(21): 2'-deoxy-thymidine-5'-phosphate-phosphorothioate
ucauguguccuacugauugtt

SEQ ID NO: 51 - DNA, 21 bp, Artificial Sequence
  Description of Artificial Sequence: Synthetic oligonucleotide
  modified_base (21)..(21): 2'-deoxy-thymidine-5'-phosphate-phosphorothioate
aaucaguaggacacaugautt

SEQ ID NO: 52 - DNA, 21 bp, Artificial Sequence
  Description of Artificial Sequence: Synthetic oligonucleotide
  modified_base (21)..(21): 2'-deoxy-thymidine-5'-phosphate-phosphorothioate
aucauguguccuacugauutt

SEQ ID NO: 53 - DNA, 21 bp, Artificial Sequence
  Description of Artificial Sequence: Synthetic oligonucleotide
  modified_base (21)..(21): 2'-deoxy-thymidine-5'-phosphate-phosphorothioate
aucaguaggacacaugaugtt

SEQ ID NO: 54 - DNA, 21 bp, Artificial Sequence
  Description of Artificial Sequence: Synthetic oligonucleotide
  modified_base (21)..(21): 2'-deoxy-thymidine-5'-phosphate-phosphorothioate
caucauguguccuacugautt

SEQ ID NO: 55 - DNA, 21 bp, Artificial Sequence
  Description of Artificial Sequence: Synthetic oligonucleotide
  modified_base (21)..(21): 2'-deoxy-thymidine-5'-phosphate-phosphorothioate
ucaguaggacacaugauggtt

SEQ ID NO: 56 - DNA, 21 bp, Artificial Sequence
  Description of Artificial Sequence: Synthetic oligonucleotide
  modified_base (21)..(21): 2'-deoxy-thymidine-5'-phosphate-phosphorothioate
ccaucauguguccuacugatt

SEQ ID NO: 57 - DNA, 21 bp, Artificial Sequence
  Description of Artificial Sequence: Synthetic oligonucleotide
  modified_base (21)..(21): 2'-deoxy-thymidine-5'-phosphate-phosphorothioate
caguaggacacaugauggutt

SEQ ID NO: 58 - DNA, 21 bp, Artificial Sequence
  Description of Artificial Sequence: Synthetic oligonucleotide
  modified_base (21)..(21): 2'-deoxy-thymidine-5'-phosphate-phosphorothioate
accaucauguguccuacugtt

SEQ ID NO: 59 - DNA, 21 bp, Artificial Sequence
  Description of Artificial Sequence: Synthetic oligonucleotide
  modified_base (21)..(21): 2'-deoxy-thymidine-5'-phosphate-phosphorothioate
aguaggacacaugauggugtt

SEQ ID NO: 60 - DNA, 21 bp, Artificial Sequence
  Description of Artificial Sequence: Synthetic oligonucleotide
  modified_base (21)..(21): 2'-deoxy-thymidine-5'-phosphate-phosphorothioate
caccaucauguguccuacutt

SEQ ID NO: 61 - DNA, 21 bp, Artificial Sequence
  Description of Artificial Sequence: Synthetic oligonucleotide
  modified_base (21)..(21): 2'-deoxy-thymidine-5'-phosphate-phosphorothioate
guaggacacaugauggugatt

SEQ ID NO: 62 - DNA, 21 bp, Artificial Sequence
  Description of Artificial Sequence: Synthetic oligonucleotide
  modified_base (21)..(21): 2'-deoxy-thymidine-5'-phosphate-phosphorothioate
ucaccaucauguguccuactt

SEQ ID NO: 63 - DNA, 21 bp, Artificial Sequence
  Description of Artificial Sequence: Synthetic oligonucleotide
  modified_base (21)..(21): 2'-deoxy-thymidine-5'-phosphate-phosphorothioate
uaggacacaugauggugautt

SEQ ID NO: 64 - DNA, 21 bp, Artificial Sequence
  Description of Artificial Sequence: Synthetic oligonucleotide
  modified_base (21)..(21): 2'-deoxy-thymidine-5'-phosphate-phosphorothioate
aucaccaucauguguccuatt

SEQ ID NO: 65 - DNA, 21 bp, Artificial Sequence
  Description of Artificial Sequence: Synthetic oligonucleotide
  modified_base (21)..(21): 2'-deoxy-thymidine-5'-phosphate-phosphorothioate
gauggugauuuuccguuugtt

SEQ ID NO: 66 - DNA, 21 bp, Artificial Sequence
  Description of Artificial Sequence: Synthetic oligonucleotide
  modified_base (21)..(21): 2'-deoxy-thymidine-5'-phosphate-phosphorothioate
caaacggaaaaucaccauctt

SEQ ID NO: 67 - DNA, 21 bp, Artificial Sequence
  Description of Artificial Sequence: Synthetic oligonucleotide
  modified_base (21)..(21): 2'-deoxy-thymidine-5'-phosphate-phosphorothioate
auggugauuuuccguuugatt

SEQ ID NO: 68 - DNA, 21 bp, Artificial Sequence
  Description of Artificial Sequence: Synthetic oligonucleotide
  modified_base (21)..(21): 2'-deoxy-thymidine-5'-phosphate-phosphorothioate
ucaaacggaaaaucaccautt

SEQ ID NO: 69 - DNA, 21 bp, Artificial Sequence
  Description of Artificial Sequence: Synthetic oligonucleotide
  modified_base (21)..(21): 2'-deoxy-thymidine-5'-phosphate-phosphorothioate
uggugauuuuccguuugautt

SEQ ID NO: 70 - DNA, 21 bp, Artificial Sequence
  Description of Artificial Sequence: Synthetic oligonucleotide
  modified_base (21)..(21): 2'-deoxy-thymidine-5'-phosphate-phosphorothioate
aucaaacggaaaaucaccatt

SEQ ID NO: 71 - DNA, 21 bp, Artificial Sequence
  Description of Artificial Sequence: Synthetic oligonucleotide
  modified_base (21)..(21): 2'-deoxy-thymidine-5'-phosphate-phosphorothioate
ggugauuuuccguuugaugtt

SEQ ID NO: 72 - DNA, 21 bp, Artificial Sequence
  Description of Artificial Sequence: Synthetic oligonucleotide
  modified_base (21)..(21): 2'-deoxy-thymidine-5'-phosphate-phosphorothioate
caucaaacggaaaaucacctt

SEQ ID NO: 73 - DNA, 21 bp, Artificial Sequence
  Description of Artificial Sequence: Synthetic oligonucleotide
  modified_base (21)..(21): 2'-deoxy-thymidine-5'-phosphate-phosphorothioate
gcugagaagcaacuccaactt

SEQ ID NO: 74 - DNA, 21 bp, Artificial Sequence
  Description of Artificial Sequence: Synthetic oligonucleotide
  modified_base (21)..(21): 2'-deoxy-thymidine-5'-phosphate-phosphorothioate
guuggaguugcuucucagctt

SEQ ID NO: 75 - DNA, 21 bp, Artificial Sequence
  Description of Artificial Sequence: Synthetic oligonucleotide
  modified_base (21)..(21): 2'-deoxy-thymidine-5'-phosphate-phosphorothioate
cugagaagcaacuccaacatt

SEQ ID NO: 76 - DNA, 21 bp, Artificial Sequence
  Description of Artificial Sequence: Synthetic oligonucleotide
  modified_base (21)..(21): 2'-deoxy-thymidine-5'-phosphate-phosphorothioate
uguuggaguugcuucucagtt

SEQ ID NO: 77 - DNA, 21 bp, Artificial Sequence
  Description of Artificial Sequence: Synthetic oligonucleotide
  modified_base (21)..(21): 2'-deoxy-thymidine-5'-phosphate-phosphorothioate
ugagaagcaacuccaacaatt

SEQ ID NO: 78 - DNA, 21 bp, Artificial Sequence
  Description of Artificial Sequence: Synthetic oligonucleotide
  modified_base (21)..(21): 2'-deoxy-thymidine-5'-phosphate-phosphorothioate
uuguuggaguugcuucucatt

SEQ ID NO: 79 - DNA, 21 bp, Artificial Sequence
  Description of Artificial Sequence: Synthetic oligonucleotide
  modified_base (21)..(21): 2'-deoxy-thymidine-5'-phosphate-phosphorothioate
gagaagcaacuccaacaautt

SEQ ID NO: 80 - DNA, 21 bp, Artificial Sequence
  Description of Artificial Sequence: Synthetic oligonucleotide
  modified_base (21)..(21): 2'-deoxy-thymidine-5'-phosphate-phosphorothioate
auuguuggaguugcuucuctt

SEQ ID NO: 81 - DNA, 21 bp, Artificial Sequence
  Description of Artificial Sequence: Synthetic oligonucleotide
  modified_base (21)..(21): 2'-deoxy-thymidine-5'-phosphate-phosphorothioate
agaagcaacuccaacaauatt

SEQ ID NO: 82 - DNA, 21 bp, Artificial Sequence
  Description of Artificial Sequence: Synthetic oligonucleotide
  modified_base (21)..(21): 2'-deoxy-thymidine-5'-phosphate-phosphorothioate
uauuguuggaguugcuucutt

SEQ ID NO: 83 - DNA, 21 bp, Artificial Sequence
  Description of Artificial Sequence: Synthetic oligonucleotide
  modified_base (21)..(21): 2'-deoxy-thymidine-5'-phosphate-phosphorothioate
aaaagugaugaagauuaagtt

SEQ ID NO: 84 - DNA, 21 bp, Artificial Sequence
  Description of Artificial Sequence: Synthetic oligonucleotide
  modified_base (21)..(21): 2'-deoxy-thymidine-5'-phosphate-phosphorothioate
cuuaaucuucaucacuuuutt

SEQ ID NO: 85 - DNA, 21 bp, Artificial Sequence
  Description of Artificial Sequence: Synthetic oligonucleotide
  modified_base (21)..(21): 2'-deoxy-thymidine-5'-phosphate-phosphorothioate
aaagugaugaagauuaagatt

SEQ ID NO: 86 - DNA, 21 bp, Artificial Sequence
  Description of Artificial Sequence: Synthetic oligonucleotide
  modified_base (21)..(21): 2'-deoxy-thymidine-5'-phosphate-phosphorothioate
ucuuaaucuucaucacuuutt

SEQ ID NO: 87 - DNA, 21 bp, Artificial Sequence
  Description of Artificial Sequence: Synthetic oligonucleotide
  modified_base (21)..(21): 2'-deoxy-thymidine-5'-phosphate-phosphorothioate
aagugaugaagauuaagaatt

SEQ ID NO: 88 - DNA, 21 bp, Artificial Sequence
  Description of Artificial Sequence: Synthetic oligonucleotide
  modified_base (21)..(21): 2'-deoxy-thymidine-5'-phosphate-phosphorothioate
uucuuaaucuucaucacuutt

SEQ ID NO: 89 - DNA, 21 bp, Artificial Sequence
  Description of Artificial Sequence: Synthetic oligonucleotide
  modified_base (21)..(21): 2'-deoxy-thymidine-5'-phosphate-phosphorothioate
agugaugaagauuaagaaatt

SEQ ID NO: 90 - DNA, 21 bp, Artificial Sequence
  Description of Artificial Sequence: Synthetic oligonucleotide
  modified_base (21)..(21): 2'-deoxy-thymidine-5'-phosphate-phosphorothioate
uuucuuaaucuucaucacutt

SEQ ID NO: 91 - DNA, 21 bp, Artificial Sequence
  Description of Artificial Sequence: Synthetic oligonucleotide
  modified_base (21)..(21): 2'-deoxy-thymidine-5'-phosphate-phosphorothioate
cugccugcugcaacauggatt

SEQ ID NO: 92 - DNA, 21 bp, Artificial Sequence
  Description of Artificial Sequence: Synthetic oligonucleotide
  modified_base (21)..(21): 2'-deoxy-thymidine-5'-phosphate-phosphorothioate
uccauguugcagcaggcagtt

SEQ ID NO: 93 - DNA, 21 bp, Artificial Sequence
  Description of Artificial Sequence: Synthetic oligonucleotide
  modified_base (21)..(21): 2'-deoxy-thymidine-5'-phosphate-phosphorothioate
ugccugcugcaacauggactt

SEQ ID NO: 94 - DNA, 21 bp, Artificial Sequence
  Description of Artificial Sequence: Synthetic oligonucleotide
  modified_base (21)..(21): 2'-deoxy-thymidine-5'-phosphate-phosphorothioate
guccauguugcagcaggcatt

SEQ ID NO: 95 - DNA, 21 bp, Artificial Sequence
  Description of Artificial Sequence: Synthetic oligonucleotide
  modified_base (21)..(21): 2'-deoxy-thymidine-5'-phosphate-phosphorothioate
ggcugaaaacugcuacaautt

SEQ ID NO: 96 - DNA, 21 bp, Artificial Sequence
  Description of Artificial Sequence: Synthetic oligonucleotide
  modified_base (21)..(21): 2'-deoxy-thymidine-5'-phosphate-phosphorothioate
auuguagcaguuuucagcctt

SEQ ID NO: 97 - DNA, 21 bp, Artificial Sequence
  Description of Artificial Sequence: Synthetic oligonucleotide
  modified_base (21)..(21): 2'-deoxy-thymidine-5'-phosphate-phosphorothioate
gcugaaaacugcuacaauctt

SEQ ID NO: 98 - DNA, 21 bp, Artificial Sequence
  Description of Artificial Sequence: Synthetic oligonucleotide
  modified_base (21)..(21): 2'-deoxy-thymidine-5'-phosphate-phosphorothioate
gauuguagcaguuuucagctt

SEQ ID NO: 99 - DNA, 21 bp, Artificial Sequence
  Description of Artificial Sequence: Synthetic oligonucleotide
  modified_base (21)..(21): 2'-deoxy-thymidine-5'-phosphate-phosphorothioate
cugaaaacugcuacaaucutt

SEQ ID NO: 100 - DNA, 21 bp, Artificial Sequence
  Description of Artificial Sequence: Synthetic oligonucleotide
  modified_base (21)..(21): 2'-deoxy-thymidine-5'-phosphate-phosphorothioate
agauuguagcaguuuucagtt

SEQ ID NO: 101 - DNA, 21 bp, Artificial Sequence
  Description of Artificial Sequence: Synthetic oligonucleotide
  modified_base (21)..(21): 2'-deoxy-thymidine-5'-phosphate-phosphorothioate
ugaaaacugcuacaaucuutt

SEQ ID NO: 102 - DNA, 21 bp, Artificial Sequence
  Description of Artificial Sequence: Synthetic oligonucleotide
  modified_base (21)..(21): 2'-deoxy-thymidine-5'-phosphate-phosphorothioate
aagauuguagcaguuuucatt

SEQ ID NO: 103 - DNA, 21 bp, Artificial Sequence
  Description of Artificial Sequence: Synthetic oligonucleotide
  modified_base (21)..(21): 2'-deoxy-thymidine-5'-phosphate-phosphorothioate
gaaaacugcuacaaucuugtt

SEQ ID NO: 104 - DNA, 21 bp, Artificial Sequence
  Description of Artificial Sequence: Synthetic oligonucleotide
  modified_base (21)..(21): 2'-deoxy-thymidine-5'-phosphate-phosphorothioate
caagauuguagcaguuuuctt

SEQ ID NO: 105 - DNA, 21 bp, Artificial Sequence
  Description of Artificial Sequence: Synthetic oligonucleotide
  modified_base (21)..(21): 2'-deoxy-thymidine-5'-phosphate-phosphorothioate
aaaacugcuacaaucuugatt

SEQ ID NO: 106 - DNA, 21 bp, Artificial Sequence
  Description of Artificial Sequence: Synthetic oligonucleotide
  modified_base (21)..(21): 2'-deoxy-thymidine-5'-phosphate-phosphorothioate
ucaagauuguagcaguuuutt

SEQ ID NO: 107 - DNA, 21 bp, Artificial Sequence
  Description of Artificial Sequence: Synthetic oligonucleotide
  modified_base (21)..(21): 2'-deoxy-thymidine-5'-phosphate-phosphorothioate
aaacugcuacaaucuugaatt

SEQ ID NO: 108 - DNA, 21 bp, Artificial Sequence
  Description of Artificial Sequence: Synthetic oligonucleotide
  modified_base (21)..(21): 2'-deoxy-thymidine-5'-phosphate-phosphorothioate
uucaagauuguagcaguuutt

SEQ ID NO: 109 - DNA, 21 bp, Artificial Sequence
  Description of Artificial Sequence: Synthetic oligonucleotide
  modified_base (21)..(21): 2'-deoxy-thymidine-5'-phosphate-phosphorothioate
aacugcuacaaucuugaaatt

SEQ ID NO: 110 - DNA, 21 bp, Artificial Sequence
  Description of Artificial Sequence: Synthetic oligonucleotide
  modified_base (21)..(21): 2'-deoxy-thymidine-5'-phosphate-phosphorothioate
uuucaagauuguagcaguutt

SEQ ID NO: 111 - DNA, 21 bp, Artificial Sequence
  Description of Artificial Sequence: Synthetic oligonucleotide
  modified_base (21)..(21): 2'-deoxy-thymidine-5'-phosphate-phosphorothioate
acugcuacaaucuugaaautt

SEQ ID NO: 112 - DNA, 21 bp, Artificial Sequence
  Description of Artificial Sequence: Synthetic oligonucleotide
  modified_base (21)..(21): 2'-deoxy-thymidine-5'-phosphate-phosphorothioate
auuucaagauuguagcagutt

SEQ ID NO: 113 - DNA, 21 bp, Artificial Sequence
  Description of Artificial Sequence: Synthetic oligonucleotide
  modified_base (21)..(21): 2'-deoxy-thymidine-5'-phosphate-phosphorothioate
agcaaauccaacggcugautt

SEQ ID NO: 114 - DNA, 21 bp, Artificial Sequence
  Description of Artificial Sequence: Synthetic oligonucleotide
  modified_base (21)..(21): 2'-deoxy-thymidine-5'-phosphate-phosphorothioate
aucagccguuggauuugcutt

SEQ ID NO: 115 - DNA, 21 bp, Artificial Sequence
  Description of Artificial Sequence: Synthetic oligonucleotide
  modified_base (21)..(21): 2'-deoxy-thymidine-5'-phosphate-phosphorothioate
gcaaauccaacggcugaugtt

SEQ ID NO: 116 - DNA, 21 bp, Artificial Sequence
  Description of Artificial Sequence: Synthetic oligonucleotide
  modified_base (21)..(21): 2'-deoxy-thymidine-5'-phosphate-phosphorothioate
caucagccguuggauuugctt

SEQ ID NO: 117 - DNA, 21 bp, Artificial Sequence
  Description of Artificial Sequence: Synthetic oligonucleotide
  modified_base (21)..(21): 2'-deoxy-thymidine-5'-phosphate-phosphorothioate
caaauccaacggcugaugatt

SEQ ID NO: 118 - DNA, 21 bp, Artificial Sequence
  Description of Artificial Sequence: Synthetic oligonucleotide
  modified_base (21)..(21): 2'-deoxy-thymidine-5'-phosphate-phosphorothioate
ucaucagccguuggauuugtt

SEQ ID NO: 119 - DNA, 21 bp, Artificial Sequence
  Description of Artificial Sequence: Synthetic oligonucleotide
  modified_base (21)..(21): 2'-deoxy-thymidine-5'-phosphate-phosphorothioate
uuggaccaaugugaccuagtt

SEQ ID NO: 120 - DNA, 21 bp, Artificial Sequence
  Description of Artificial Sequence: Synthetic oligonucleotide
  modified_base (21)..(21): 2'-deoxy-thymidine-5'-phosphate-phosphorothioate
cuaggucacauugguccaatt

SEQ ID NO: 121 - DNA, 21 bp, Artificial Sequence
  Description of Artificial Sequence: Synthetic oligonucleotide
  modified_base (21)..(21): 2'-deoxy-thymidine-5'-phosphate-phosphorothioate
uggaccaaugugaccuagutt

SEQ ID NO: 122 - DNA, 21 bp, Artificial Sequence
  Description of Artificial Sequence: Synthetic oligonucleotide
  modified_base (21)..(21): 2'-deoxy-thymidine-5'-phosphate-phosphorothioate
acuaggucacauugguccatt

SEQ ID NO: 123 - DNA, 21 bp, Artificial Sequence
  Description of Artificial Sequence: Synthetic oligonucleotide
  modified_base (21)..(21): 2'-deoxy-thymidine-5'-phosphate-phosphorothioate
augcaugucagugauuauutt

SEQ ID NO: 124 - DNA, 21 bp, Artificial Sequence
  Description of Artificial Sequence: Synthetic oligonucleotide
  modified_base (21)..(21): 2'-deoxy-thymidine-5'-phosphate-phosphorothioate
aauaaucacugacaugcautt

SEQ ID NO: 125 - DNA, 21 bp, Artificial Sequence
  Description of Artificial Sequence: Synthetic oligonucleotide
  modified_base (21)..(21): 2'-deoxy-thymidine-5'-phosphate-phosphorothioate
ugcaugucagugauuauuatt

SEQ ID NO: 126 - DNA, 21 bp, Artificial Sequence
  Description of Artificial Sequence: Synthetic oligonucleotide
  modified_base (21)..(21): 2'-deoxy-thymidine-5'-phosphate-phosphorothioate
uaauaaucacugacaugcatt

SEQ ID NO: 127 - DNA, 21 bp, Artificial Sequence
  Description of Artificial Sequence: Synthetic oligonucleotide
  modified_base (21)..(21): 2'-deoxy-thymidine-5'-phosphate-phosphorothioate
gcaugucagugauuauuautt

SEQ ID NO: 128 - DNA, 21 bp, Artificial Sequence
  Description of Artificial Sequence: Synthetic oligonucleotide
  modified_base (21)..(21): 2'-deoxy-thymidine-5'-phosphate-phosphorothioate
auaauaaucacugacaugctt

SEQ ID NO: 129 - DNA, 21 bp, Artificial Sequence
  Description of Artificial Sequence: Synthetic oligonucleotide
  modified_base (21)..(21): 2'-deoxy-thymidine-5'-phosphate-phosphorothioate
caugucagugauuauuauatt

SEQ ID NO: 130 - DNA, 21 bp, Artificial Sequence
  Description of Artificial Sequence: Synthetic oligonucleotide
  modified_base (21)..(21): 2'-deoxy-thymidine-5'-phosphate-phosphorothioate
uauaauaaucacugacaugtt

SEQ ID NO: 131 - DNA, 21 bp, Artificial Sequence
  Description of Artificial Sequence: Synthetic oligonucleotide
  modified_base (21)..(21): 2'-deoxy-thymidine-5'-phosphate-phosphorothioate
augucagugauuauuauaatt

SEQ ID NO: 132 - DNA, 21 bp, Artificial Sequence
  Description of Artificial Sequence: Synthetic oligonucleotide
  modified_base (21)..(21): 2'-deoxy-thymidine-5'-phosphate-phosphorothioate
uuauaauaaucacugacautt

SEQ ID NO: 133 - DNA, 21 bp, Artificial Sequence
  Description of Artificial Sequence: Synthetic oligonucleotide
  modified_base (21)..(21): 2'-deoxy-thymidine-5'-phosphate-phosphorothioate
uuauuauaauccaccacautt

SEQ ID NO: 134 - DNA, 21 bp, Artificial Sequence
  Description of Artificial Sequence: Synthetic oligonucleotide
  modified_base (21)..(21): 2'-deoxy-thymidine-5'-phosphate-phosphorothioate
augugguggauuauaauaatt

SEQ ID NO: 135 - DNA, 21 bp, Artificial Sequence
  Description of Artificial Sequence: Synthetic oligonucleotide
  modified_base (21)..(21): 2'-deoxy-thymidine-5'-phosphate-phosphorothioate
uauuauaauccaccacauatt

SEQ ID NO: 136 - DNA, 21 bp, Artificial Sequence
  Description of Artificial Sequence: Synthetic oligonucleotide
  modified_base (21)..(21): 2'-deoxy-thymidine-5'-phosphate-phosphorothioate
uaugugguggauuauaauatt

SEQ ID NO: 137 - DNA, 21 bp, Artificial Sequence
  Description of Artificial Sequence: Synthetic oligonucleotide
  modified_base (21)..(21): 2'-deoxy-thymidine-5'-phosphate-phosphorothioate
auuauaauccaccacauaatt

SEQ ID NO: 138 - DNA, 21 bp, Artificial Sequence
  Description of Artificial Sequence: Synthetic oligonucleotide
  modified_base (21)..(21): 2'-deoxy-thymidine-5'-phosphate-phosphorothioate
uuaugugguggauuauaautt

SEQ ID NO: 139 - DNA, 21 bp, Artificial Sequence
  Description of Artificial Sequence: Synthetic oligonucleotide
  modified_base (21)..(21): 2'-deoxy-thymidine-5'-phosphate-phosphorothioate
aaaguuacaagugccugugtt

SEQ ID NO: 140 - DNA, 21 bp, Artificial Sequence
  Description of Artificial Sequence: Synthetic oligonucleotide
  modified_base (21)..(21): 2'-deoxy-thymidine-5'-phosphate-phosphorothioate
cacaggcacuuguaacuuutt

SEQ ID NO: 141 - DNA, 21 bp, Artificial Sequence
  Description of Artificial Sequence: Synthetic oligonucleotide
  modified_base (21)..(21): 2'-deoxy-thymidine-5'-phosphate-phosphorothioate
aaguuacaagugccuguggtt

SEQ ID NO: 142 - DNA, 21 bp, Artificial Sequence
  Description of Artificial Sequence: Synthetic oligonucleotide
  modified_base (21)..(21): 2'-deoxy-thymidine-5'-phosphate-phosphorothioate
ccacaggcacuuguaacuutt

SEQ ID NO: 143 - DNA, 21 bp, Artificial Sequence
  Description of Artificial Sequence: Synthetic oligonucleotide
  modified_base (21)..(21): 2'-deoxy-thymidine-5'-phosphate-phosphorothioate
ucagguuuuaucuauuuugtt

SEQ ID NO: 144 - DNA, 21 bp, Artificial Sequence
  Description of Artificial Sequence: Synthetic oligonucleotide
  modified_base (21)..(21): 2'-deoxy-thymidine-5'-phosphate-phosphorothioate
caaaauagauaaaaccugatt

SEQ ID NO: 145 - DNA, 21 bp, Artificial Sequence
  Description of Artificial Sequence: Synthetic oligonucleotide
  modified_base (21)..(21): 2'-deoxy-thymidine-5'-phosphate-phosphorothioate
cagguuuuaucuauuuuggtt

SEQ ID NO: 146 - DNA, 21 bp, Artificial Sequence
  Description of Artificial Sequence: Synthetic oligonucleotide
  modified_base (21)..(21): 2'-deoxy-thymidine-5'-phosphate-phosphorothioate
ccaaaauagauaaaaccugtt

SEQ ID NO: 147 - DNA, 21 bp, Artificial Sequence
  Description of Artificial Sequence: Synthetic oligonucleotide
  modified_base (21)..(21): 2'-deoxy-thymidine-5'-phosphate-phosphorothioate
ucugaugcaauuuuugaugtt

SEQ ID NO: 148 - DNA, 21 bp, Artificial Sequence
  Description of Artificial Sequence: Synthetic oligonucleotide
  modified_base (21)..(21): 2'-deoxy-thymidine-5'-phosphate-phosphorothioate
caucaaaaauugcaucagatt

SEQ ID NO: 149 - DNA, 21 bp, Artificial Sequence
  Description of Artificial Sequence: Synthetic oligonucleotide
  modified_base (21)..(21): 2'-deoxy-thymidine-5'-phosphate-phosphorothioate
cugaugcaauuuuugaugatt

SEQ ID NO: 150 - DNA, 21 bp, Artificial Sequence
  Description of Artificial Sequence: Synthetic oligonucleotide
  modified_base (21)..(21): 2'-deoxy-thymidine-5'-phosphate-phosphorothioate
ucaucaaaaauugcaucagtt

SEQ ID NO: 151 - DNA, 21 bp, Artificial Sequence
  Description of Artificial Sequence: Synthetic oligonucleotide
  modified_base (3)..(3): 2'-O-methyluridine-5'-phosphate
  modified_base (9)..(10): 2'-O-methyluridine-5'-phosphate
  modified_base (15)..(16): 2'-O-methylcytidine-5'-phosphate
  modified_base (17)..(18): 2'-O-methyluridine-5'-phosphate
  modified_base (19)..(19): 2'-O-methylcytidine-5'-phosphate
  modified_base (21)..(21): 2'-deoxy-thymidine-5'-phosphate-phosphorothioate
gangaagannaaaannnnntt

SEQ ID NO: 152 - DNA, 21 bp, Artificial Sequence
  Description of Artificial Sequence: Synthetic oligonucleotide
  modified_base (9)..(9): 2'-O-methyluridine-5'-phosphate
  modified_base (16)..(16): 2'-O-methylcytidine-5'-phosphate
  modified_base (21)..(21): 2'-deoxy-thymidine-5'-phosphate-phosphorothioate
gaagguuunaaucuunauctt

SEQ ID NO: 153 - DNA, 21 bp, Artificial Sequence
  Description of Artificial Sequence: Synthetic oligonucleotide
  modified_base (2)..(2): 2'-O-methyluridine-5'-phosphate
  modified_base (8)..(9): 2'-O-methyluridine-5'-phosphate
  modified_base (14)..(15): 2'-O-methylcytidine-5'-phosphate
  modified_base (16)..(17): 2'-O-methyluridine-5'-phosphate
  modified_base (18)..(18): 2'-O-methylcytidine-5'-phosphate
  modified_base (21)..(21): 2'-deoxy-thymidine-5'-phosphate-phosphorothioate
angaagannaaaannnnnatt

SEQ ID NO: 154 - DNA, 21 bp, Artificial Sequence
  Description of Artificial Sequence: Synthetic oligonucleotide
  modified_base (10)..(10): 2'-O-methyluridine-5'-phosphate
  modified_base (17)..(17): 2'-O-methylcytidine-5'-phosphate
  modified_base (21)..(21): 2'-deoxy-thymidine-5'-phosphate-phosphorothioate
ugaagguuunaaucuunautt

SEQ ID NO: 155 - DNA, 21 bp, Artificial Sequence
  Description of Artificial Sequence: Synthetic oligonucleotide
  modified_base (1)..(1): 2'-O-methyluridine-5'-phosphate
  modified_base (7)..(8): 2'-O-methyluridine-5'-phosphate
  modified_base (13)..(14): 2'-O-methylcytidine-5'-phosphate
  modified_base (15)..(16): 2'-O-methyluridine-5'-phosphate
  modified_base (17)..(17): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
ngaagannaaaannnnnantt

SEQ ID NO: 156 - DNA, 21 bp, Artificial Sequence
  Description of Artificial Sequence: Synthetic oligonucleotide
  modified_base (11)..(11): 2'-O-methyluridine-5'-phosphate
  modified_base (18)..(18): 2'-O-methylcytidine-5'-phosphate
  modified_base (21)..(21): 2'-deoxy-thymidine-5'-phosphate-phosphorothioate
augaagguuunaaucuunatt

SEQ ID NO: 157 - DNA, 21 bp, Artificial Sequence
  Description of Artificial Sequence: Synthetic oligonucleotide
  modified_base (6)..(7): 2'-O-methyluridine-5'-phosphate
  modified_base (12)..(13): 2'-O-methylcytidine-5'-phosphate
  modified_base (14)..(15): 2'-O-methyluridine-5'-phosphate
  modified_base (16)..(16): 2'-O-methylcytidine-5'-phosphate
  modified_base (18)..(18): 2'-O-methyluridine-5'-phosphate
  modified_base (19)..(19): 2'-O-methylcytidine-5'-phosphate
  modified_base (21)..(21): 2'-deoxy-thymidine-5'-phosphate-phosphorothioate
gaagannaaaannnnnanntt

SEQ ID NO: 158 - DNA, 21 bp, Artificial Sequence
  Description of Artificial Sequence: Synthetic oligonucleotide
  modified_base (12)..(12): 2'-O-methyluridine-5'-phosphate
  modified_base (21)..(21): 2'-deoxy-thymidine-5'-phosphate-phosphorothioate
gaugaagguuunaaucuuctt

SEQ ID NO: 159 - DNA, 21 bp, Artificial Sequence
  Description of Artificial Sequence: Synthetic oligonucleotide
  modified_base (1)..(1): 2'-O-methyluridine-5'-phosphate
  modified_base (4)..(4): 2'-O-methyluridine-5'-phosphate
  modified_base (10)..(11): 2'-O-methyluridine-5'-phosphate
  modified_base (21)..(21): 2'-deoxy-thymidine-5'-phosphate-phosphorothioate
ngangaagannaagaaaaatt

SEQ ID NO: 160 - DNA, 21 bp, Artificial Sequence
  Description of Artificial Sequence: Synthetic oligonucleotide
  modified_base (8)..(8): 2'-O-methyluridine-5'-phosphate
  modified_base (15)..(15): 2'-O-methylcytidine-5'-phosphate
  modified_base (18)..(18): 2'-O-methylcytidine-5'-phosphate
  modified_base (21)..(21): 2'-deoxy-thymidine-5'-phosphate-phosphorothioate
uuuuucunaaucuunaunatt

SEQ ID NO: 161 - DNA, 21 bp, Artificial Sequence
  Description of Artificial Sequence: Synthetic oligonucleotide
  modified_base (5)..(6): 2'-O-methyluridine-5'-phosphate
  modified_base (11)..(12): 2'-O-methylcytidine-5'-phosphate
  modified_base (13)..(14): 2'-O-methyluridine-5'-phosphate
  modified_base (15)..(15): 2'-O-methylcytidine-5'-phosphate
  modified_base (17)..(17): 2'-O-methyluridine-5'-phosphate
  modified_base (18)..(18): 2'-O-methylcytidine-5'-phosphate
  modified_base (21)..(21): 2'-deoxy-thymidine-5'-phosphate-phosphorothioate
aagannaaaannnnnannatt

SEQ ID NO: 162 - DNA, 21 bp, Artificial Sequence
  Description of Artificial Sequence: Synthetic oligonucleotide
  modified_base (13)..(13): 2'-O-methyluridine-5'-phosphate
  modified_base (21)..(21): 2'-deoxy-thymidine-5'-phosphate-phosphorothioate
ugaugaagguuunaaucuutt

SEQ ID NO: 163 - DNA, 21 bp, Artificial Sequence
  Description of Artificial Sequence: Synthetic oligonucleotide
  modified_base (4)..(5): 2'-O-methyluridine-5'-phosphate
  modified_base (10)..(11): 2'-O-methylcytidine-5'-phosphate
  modified_base (12)..(13): 2'-O-methyluridine-5'-phosphate
  modified_base (14)..(14): 2'-O-methylcytidine-5'-phosphate
  modified_base (16)..(16): 2'-O-methyluridine-5'-phosphate
  modified_base (17)..(17): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
agannaaaannnnnannantt

SEQ ID NO: 164 - DNA, 21 bp, Artificial Sequence
  Description of Artificial Sequence: Synthetic oligonucleotide
  modified_base (14)..(14): 2'-O-methyluridine-5'-phosphate
  modified_base (21)..(21): 2'-deoxy-thymidine-5'-phosphate-phosphorothioate
augaugaagguuunaaucutt

SEQ ID NO: 165 - DNA, 21 bp, Artificial Sequence
  Description of Artificial Sequence: Synthetic oligonucleotide
  modified_base (3)..(4): 2'-O-methyluridine-5'-phosphate
  modified_base (9)..(10): 2'-O-methylcytidine-5'-phosphate
  modified_base (11)..(12): 2'-O-methyluridine-5'-phosphate
  modified_base (13)..(13): 2'-O-methylcytidine-5'-phosphate
  modified_base (15)..(15): 2'-O-methyluridine-5'-phosphate
  modified_base (16)..(16): 2'-O-methylcytidine-5'-phosphate
  modified_base (18)..(18): 2'-O-methyluridine-5'-phosphateu
  modified_base (19)..(19): 2'-O-methylcytidine-5'-phosphate
  modified_base (21)..(21): 2'-deoxy-thymidine-5'-phosphate-phosphorothioate
gannaaaannnnnannanntt

SEQ ID NO: 166 - DNA, 21 bp, Artificial Sequence
  Description of Artificial Sequence: Synthetic oligonucleotide
  modified_base (15)..(15): 2'-O-methyluridine-5'-phosphate
  modified_base (21)..(21): 2'-deoxy-thymidine-5'-phosphate-phosphorothioate
gaugaugaagguuunaauctt

SEQ ID NO: 167 - DNA, 21 bp, Artificial Sequence
  Description of Artificial Sequence: Synthetic oligonucleotide
  modified_base (2)..(3): 2'-O-methyluridine-5'-phosphate
  modified_base (8)..(9): 2'-O-methylcytidine-5'-phosphate
  modified_base (10)..(11): 2'-O-methyluridine-5'-phosphate
  modified_base (12)..(12): 2'-O-methylcytidine-5'-phosphate
  modified_base (14)..(14): 2'-O-methyluridine-5'-phosphate
  modified_base (15)..(15): 2'-O-methylcytidine-5'-phosphate
  modified_base (17)..(17): 2'-O-methyluridine-5'-phosphate
  modified_base (18)..(19): 2'-O-methylcytidine-5'-phosphate
  modified_base (21)..(21): 2'-deoxy-thymidine-5'-phosphate-phosphorothioate
annaaaannnnnannannntt

SEQ ID NO: 168 - DNA, 21 bp, Artificial Sequence
  Description of Artificial Sequence: Synthetic oligonucleotide
  modified_base (16)..(16): 2'-O-methyluridine-5'-phosphate
  modified_base (21)..(21): 2'-deoxy-thymidine-5'-phosphate-phosphorothioate
ggaugaugaagguuunaautt

SEQ ID NO: 169 - DNA, 21 bp, Artificial Sequence
  Description of Artificial Sequence: Synthetic oligonucleotide
  modified_base (1)..(2): 2'-O-methyluridine-5'-phosphate
  modified_base (7)..(8): 2'-O-methylcytidine-5'-phosphate
  modified_base (9)..(10): 2'-O-methyluridine-5'-phosphate
  modified_base (11)..(11): 2'-O-methylcytidine-5'-phosphate
  modified_base (13)..(13): 2'-O-methyluridine-5'-phosphate
  modified_base (14)..(14): 2'-O-methylcytidine-5'-phosphate
  modified_base (16)..(16): 2'-O-methyluridine-5'-phosphate
  modified_base (17)..(18): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
nnaaaannnnnannannnntt

SEQ ID NO: 170 - DNA, 21 bp, Artificial Sequence
  Description of Artificial Sequence: Synthetic oligonucleotide
  modified_base (17)..(17): 2'-O-methyluridine-5'-phosphate
  modified_base (21)..(21): 2'-deoxy-thymidine-5'-phosphate-phosphorothioate
aggaugaugaagguuunaatt

SEQ ID NO: 171 - DNA, 21 bp, Artificial Sequence
  Description of Artificial Sequence: Synthetic oligonucleotide
  modified_base (1)..(1): 2'-O-methyluridine-5'-phosphate
  modified_base (6)..(7): 2'-O-methylcytidine-5'-phosphate
  modified_base (8)..(9): 2'-O-methyluridine-5'-phosphateu
  modified_base (10)..(10): 2'-O-methylcytidine-5'-phosphate
  modified_base (12)..(12): 2'-O-methyluridine-5'-phosphate
  modified_base (13)..(13): 2'-O-methylcytidine-5'-phosphate
  modified_base (15)..(15): 2'-O-methyluridine-5'-phosphate
  modified_base (16)..(17): 2'-O-methylcytidine-5'-phosphate
  modified_base (18)..(19): 2'-O-methyluridine-5'-phosphate
  modified_base (21)..(21): 2'-deoxy-thymidine-5'-phosphate-phosphorothioate
naaaannnnnannannnnntt

SEQ ID NO: 172 - DNA, 21 bp, Artificial Sequence
  Description of Artificial Sequence: Synthetic oligonucleotide
  modified_base (18)..(18): 2'-O-methyluridine-5'-phosphate
  modified_base (21)..(21): 2'-deoxy-thymidine-5'-phosphate-phosphorothioate
aaggaugaugaagguuunatt

SEQ ID NO: 173 - DNA, 21 bp, Artificial Sequence
  Description of Artificial Sequence: Synthetic oligonucleotide
  modified_base (3)..(3): 2'-O-methyluridine-5'-phosphate
  modified_base (9)..(10): 2'-O-methyluridine-5'-phosphate
  modified_base (21)..(21): 2'-deoxy-thymidine-5'-phosphate-phosphorothioate
gangaagannaagaaaaagtt

SEQ ID NO: 174 - DNA, 21 bp, Artificial Sequence
  Description of Artificial Sequence: Synthetic oligonucleotide
  modified_base (9)..(9): 2'-O-methyluridine-5'-phosphate
  modified_base (16)..(16): 2'-O-methylcytidine-5'-phosphate
  modified_base (21)..(21): 2'-deoxy-thymidine-5'-phosphate-phosphorothioate
cuuuuucunaaucuunauctt

SEQ ID NO: 175 - DNA, 21 bp, Artificial Sequence
  Description of Artificial Sequence: Synthetic oligonucleotide
  modified_base (1)..(1): 2'-O-methyluridine-5'-phosphate
  modified_base (5)..(5): 2'-O-methylcytidine-5'-phosphate
  modified_base (6)..(6): 2'-O-methyluridine-5'-phosphate
  modified_base (8)..(8): 2'-O-methyluridine-5'-phosphate
  modified_base (13)..(13): 2'-O-methyluridine-5'-phosphate
  modified_base (15)..(15): 2'-O-methylcytidine-5'-phosphate
  modified_base (17)..(18): 2'-O-methyluridine-5'-phosphate
  modified_base (21)..(21): 2'-deoxy-thymidine-5'-phosphate-phosphorothioate
ngaannanagggnangnnatt

SEQ ID NO: 176 - DNA, 21 bp, Artificial Sequence
  Description of Artificial Sequence: Synthetic oligonucleotide
  modified_base (1)..(1): 2'-O-methyluridine-5'-phosphate
  modified_base (6)..(6): 2'-O-methyluridine-5'-phosphate
  modified_base (11)..(11): 2'-O-methyluridine-5'-phosphate
  modified_base (13)..(13): 2'-O-methyluridine-5'-phosphate
  modified_base (18)..(18): 2'-O-methylcytidine-5'-phosphate
  modified_base (21)..(21): 2'-deoxy-thymidine-5'-phosphate-phosphorothioate
naacgnacccnanaguunatt

SEQ ID NO: 177 - DNA, 21 bp, Artificial Sequence
  Description of Artificial Sequence: Synthetic oligonucleotide
  modified_base (1)..(1): 2'-O-methylcytidine-5'-phosphate
  modified_base (2)..(2): 2'-O-methyluridine-5'-phosphate
  modified_base (4)..(4): 2'-O-methyluridine-5'-phosphate
  modified_base (9)..(9): 2'-O-methyluridine-5'-phosphate
  modified_base (11)..(11): 2'-O-methylcytidine-5'-phosphate
  modified_base (13)..(14): 2'-O-methyluridine-5'-phosphate
  modified_base (16)..(16): 2'-O-methylcytidine-5'-phosphate
  modified_base (18)..(19): 2'-O-methyluridine-5'-phosphate
  modified_base (21)..(21): 2'-deoxy-thymidine-5'-phosphate-phosphorothioate
nnanagggnangnnananntt

SEQ ID NO: 178 - DNA, 21 bp, Artificial Sequence
  Description of Artificial Sequence: Synthetic oligonucleotide
  modified_base (5)..(5): 2'-O-methyluridine-5'-phosphate
  modified_base (10)..(10): 2'-O-methyluridine-5'-phosphate
  modified_base (15)..(15): 2'-O-methyluridine-5'-phosphate
  modified_base (17)..(17): 2'-O-methyluridine-5'-phosphate
  modified_base (21)..(21): 2'-deoxy-thymidine-5'-phosphate-phosphorothioate
aaugnaacgnacccnanagtt

SEQ ID NO: 179 - DNA, 21 bp, Artificial Sequence
  Description of Artificial Sequence: Synthetic oligonucleotide
  modified_base (4)..(5): 2'-O-methyluridine-5'-phosphate
  modified_base (7)..(7): 2'-O-methyluridine-5'-phosphate
  modified_base (9)..(9): 2'-O-methylcytidine-5'-phosphate
  modified_base (10)..(10): 2'-O-methyluridine-5'-phosphate
  modified_base (12)..(12): 2'-O-methylcytidine-5'-phosphate
  modified_base (14)..(14): 2'-O-methylcytidine-5'-phosphate
  modified_base (16)..(16): 2'-O-methyluridine-5'-phosphate
  modified_base (17)..(19): 2'-O-methylcytidine-5'-phosphate
  modified_base (21)..(21): 2'-deoxy-thymidine-5'-phosphate-phosphorothioate
ggannangnnangnannnntt

SEQ ID NO: 180 - DNA, 21 bp, Artificial Sequence
  Description of Artificial Sequence: Synthetic oligonucleotide
  modified_base (9)..(9): 2'-O-methyluridine-5'-phosphate
  modified_base (12)..(12): 2'-O-methylcytidine-5'-phosphate
  modified_base (14)..(14): 2'-O-methyluridine-5'-phosphate
  modified_base (21)..(21): 2'-deoxy-thymidine-5'-phosphate-phosphorothioate
gggaugcgnagnanaaucctt

SEQ ID NO: 181 - DNA, 21 bp, Artificial Sequence
  Description of Artificial Sequence: Synthetic oligonucleotide
  modified_base (1)..(2): 2'-O-methyluridine-5'-phosphate
  modified_base (7)..(7): 2'-O-methylcytidine-5'-phosphate
  modified_base (10)..(10): 2'-O-methylcytidine-5'-phosphate
  modified_base (12)..(12): 2'-O-methylcytidine-5'-phosphate
  modified_base (14)..(15): 2'-O-methyluridine-5'-phosphate
  modified_base (17)..(17): 2'-O-methylcytidine-5'-phosphate
  modified_base (21)..(21): 2'-deoxy-thymidine-5'-phosphate-phosphorothioate
nnagaanaangnannangatt

SEQ ID NO: 182 - DNA, 21 bp, Artificial Sequence
  Description of Artificial Sequence: Synthetic oligonucleotide
  modified_base (4)..(4): 2'-O-methyluridine-5'-phosphate
  modified_base (17)..(17): 2'-O-methyluridine-5'-phosphate
  modified_base (21)..(21): 2'-deoxy-thymidine-5'-phosphate-phosphorothioate
ucgnaaugcguuguucnaatt

SEQ ID NO: 183 - DNA, 21 bp, Artificial Sequence
  Description of Artificial Sequence: Synthetic oligonucleotide
  modified_base (2)..(2): 2'-O-methylcytidine-5'-phosphate
  modified_base (5)..(5): 2'-O-methylcytidine-5'-phosphate
  modified_base (7)..(7): 2'-O-methylcytidine-5'-phosphate
  modified_base (9)..(10): 2'-O-methyluridine-5'-phosphate
  modified_base (12)..(12): 2'-O-methylcytidine-5'-phosphate
  modified_base (16)..(16): 2'-O-methyluridine-5'-phosphate
  modified_base (17)..(17): 2'-O-methylcytidine-5'-phosphate
  modified_base (18)..(19): 2'-O-methyluridine-5'-phosphate
  modified_base (21)..(21): 2'-deoxy-thymidine-5'-phosphate-phosphorothioate
anaangnannangagnnnntt

SEQ ID NO: 184 - DNA, 21 bp, Artificial Sequence
  Description of Artificial Sequence: Synthetic oligonucleotide
  modified_base (9)..(9): 2'-O-methyluridine-5'-phosphate
  modified_base (21)..(21): 2'-deoxy-thymidine-5'-phosphate-phosphorothioate
aagacucgnaaugcguugutt

SEQ ID NO: 185 - DNA, 21 bp, Artificial Sequence
  Description of Artificial Sequence: Synthetic oligonucleotide
  modified_base (1)..(1): 2'-O-methyluridine-5'-phosphate
  modified_base (4)..(4): 2'-O-methyluridine-5'-phosphate
  modified_base (5)..(5): 2'-O-methylcytidine-5'-phosphate
  modified_base (10)..(11): 2'-O-methyluridine-5'-phosphate
  modified_base (15)..(15): 2'-O-methyluridine-5'-phosphate
  modified_base (17)..(17): 2'-O-methyluridine-5'-phosphate
  modified_base (19)..(19): 2'-O-methyluridine-5'-phosphate
  modified_base (21)..(21): 2'-deoxy-thymidine-5'-phosphate-phosphorothioate
nganngaggnngggnangntt

SEQ ID NO: 186 - DNA, 21 bp, Artificial Sequence
  Description of Artificial Sequence: Synthetic oligonucleotide
  modified_base (2)..(2): 2'-O-methylcytidine-5'-phosphate
  modified_base (4)..(4): 2'-O-methyluridine-5'-phosphate
  modified_base (8)..(8): 2'-O-methylcytidine-5'-phosphate
  modified_base (18)..(18): 2'-O-methylcytidine-5'-phosphate
  modified_base (21)..(21): 2'-deoxy-thymidine-5'-phosphate-phosphorothioate
ananaccnaaccucgaunatt

SEQ ID NO: 187 - DNA, 21 bp, Artificial Sequence
  Description of Artificial Sequence: Synthetic oligonucleotide
  modified_base (1)..(2): 2'-O-methylcytidine-5'-phosphate
  modified_base (3)..(3): 2'-O-methyluridine-5'-phosphate
  modified_base (4)..(4): 2'-O-methylcytidine-5'-phosphate
  modified_base (6)..(6): 2'-O-methyluridine-5'-phosphate
  modified_base (9)..(9): 2'-O-methyluridine-5'-phosphate
  modified_base (10)..(10): 2'-O-methylcytidine-5'-phosphate
  modified_base (13)..(14): 2'-O-methyluridine-5'-phosphate
  modified_base (15)..(15): 2'-O-methylcytidine-5'-phosphate
  modified_base (21)..(21): 2'-deoxy-thymidine-5'-phosphate-phosphorothioate
nnnngnganngannnaagatt

SEQ ID NO: 188 - DNA, 21 bp, Artificial Sequence
  Description of Artificial Sequence: Synthetic oligonucleotide
  modified_base (13)..(13): 2'-O-methylcytidine-5'-phosphate
  modified_base (21)..(21): 2'-deoxy-thymidine-5'-phosphate-phosphorothioate
ucuugaaucgaunacgaggtt

SEQ ID NO: 189 - DNA, 21 bp, Artificial Sequence
  Description of Artificial Sequence: Synthetic oligonucleotide
  modified_base (2)..(3): 2'-O-methyluridine-5'-phosphate
  modified_base (5)..(6): 2'-O-methylcytidine-5'-phosphate
  modified_base (7)..(7): 2'-O-methyluridine-5'-phosphate
  modified_base (8)..(8): 2'-O-methylcytidine-5'-phosphate
  modified_base (10)..(10): 2'-O-methyluridine-5'-phosphate
  modified_base (13)..(13): 2'-O-methyluridine-5'-phosphate
  modified_base (14)..(14): 2'-O-methylcytidine-5'-phosphate
  modified_base (17)..(18): 2'-O-methyluridine-5'-phosphate
  modified_base (19)..(19): 2'-O-methylcytidine-5'-phosphate
  modified_base (21)..(21): 2'-deoxy-thymidine-5'-phosphate-phosphorothioate
gnnannnngnganngannnty

SEQ ID NO: 190 - DNA, 21 bp, Artificial Sequence
  Description of Artificial Sequence: Synthetic oligonucleotide
  modified_base (9)..(9): 2'-O-methylcytidine-5'-phosphate
  modified_base (16)..(16): 2'-O-methyluridine-5'-phosphate
  modified_base (21)..(21): 2'-deoxy-thymidine-5'-phosphate-phosphorothioate
gaaucgaunacgaggnaactt

SEQ ID NO: 191 - DNA, 21 bp, Artificial Sequence
  Description of Artificial Sequence: Synthetic oligonucleotide
  modified_base (3)..(3): 2'-O-methylcytidine-5'-phosphate
  modified_base (6)..(6): 2'-O-methylcytidine-5'-phosphate
  modified_base (7)..(9): 2'-O-methyluridine-5'-phosphate
  modified_base (10)..(10): 2'-O-methylcytidine-5'-phosphate
  modified_base (12)..(12): 2'-O-methylcytidine-5'-phosphate
  modified_base (13)..(13): 2'-O-methyluridine-5'-phosphate
  modified_base (19)..(19): 2'-O-methyluridine-5'-phosphate
  modified_base (21)..(21): 2'-deoxy-thymidine-5'-phosphate-phosphorothioate
aangannnnngnngaaggntt

SEQ ID NO: 192 - DNA, 21 bp, Artificial Sequence
  Description of Artificial Sequence: Synthetic oligonucleotide
  modified_base (6)..(6): 2'-O-methylcytidine-5'-phosphate
  modified_base (21)..(21): 2'-deoxy-thymidine-5'-phosphate-phosphorothioate
accuunagcgaaagucguutt

SEQ ID NO: 193 - DNA, 21 bp, Artificial Sequence
  Description of Artificial Sequence: Synthetic oligonucleotide
  modified_base (2)..(2): 2'-O-methylcytidine-5'-phosphate
  modified_base (9)..(11): 2'-O-methylcytidine-5'-phosphate
  modified_base (13)..(13): 2'-O-methyluridine-5'-phosphate
  modified_base (14)..(14): 2'-O-methylcytidine-5'-phosphate
  modified_base (15)..(15): 2'-O-methyluridine-5'-phosphate
  modified_base (18)..(18): 2'-O-methyluridine-5'-phosphate
  modified_base (21)..(21): 2'-deoxy-thymidine-5'-phosphate-phosphorothioate
anggaggannngnnnagngtt

SEQ ID NO: 194 - DNA, 21 bp, Artificial Sequence
  Description of Artificial Sequence: Synthetic oligonucleotide
  modified_base (1)..(1): 2'-O-methylcytidine-5'-phosphate
  modified_base (4)..(4): 2'-O-methyluridine-5'-phosphate
  modified_base (21)..(21): 2'-deoxy-thymidine-5'-phosphate-phosphorothioate
nacnagacggguccuccgutt

SEQ ID NO: 195 - DNA, 21 bp, Artificial Sequence
  Description of Artificial Sequence: Synthetic oligonucleotide
  modified_base (4)..(4): 2'-O-methyluridine-5'-phosphate
  modified_base (5)..(5): 2'-O-methylcytidine-5'-phosphate
  modified_base (8)..(11): 2'-O-methylcytidine-5'-phosphate
  modified_base (16)..(17): 2'-O-methyluridine-5'-phosphate
  modified_base (21)..(21): 2'-deoxy-thymidine-5'-phosphate-phosphorothioate
aggnnaannnngaaanngatt

SEQ ID NO: 196 - DNA, 21 bp, Artificial Sequence
  Description of Artificial Sequence: Synthetic oligonucleotide
  modified_base (2)..(2): 2'-O-methylcytidine-5'-phosphate
  modified_base (21)..(21): 2'-deoxy-thymidine-5'-phosphate-phosphorothioate
unaauuucgggguugaccutt

SEQ ID NO: 197 - DNA, 21 bp, Artificial Sequence
  Description of Artificial Sequence: Synthetic oligonucleotide
  modified_base (4)..(5): 2'-O-methyluridine-5'-phosphate
  modified_base (8)..(8): 2'-O-methyluridine-5'-phosphate
  modified_base (10)..(10): 2'-O-methylcytidine-5'-phosphate
  modified_base (13)..(13): 2'-O-methylcytidine-5'-phosphate
  modified_base (16)..(16): 2'-O-methyluridine-5'-phosphate
  modified_base (17)..(17): 2'-O-methylcytidine-5'-phosphate
  modified_base (21)..(21): 2'-deoxy-thymidine-5'-phosphate-phosphorothioate
aaanngananaanaannggtt

SEQ ID NO: 198 - DNA, 21 bp, Artificial Sequence
  Description of Artificial Sequence: Synthetic oligonucleotide
  modified_base (11)..(11): 2'-O-methyluridine-5'-phosphate
  modified_base (14)..(14): 2'-O-methylcytidine-5'-phosphate
  modified_base (21)..(21): 2'-deoxy-thymidine-5'-phosphate-phosphorothioate
ccgauuguugnaunaauuutt

SEQ ID NO: 199 - DNA, 21 bp, Artificial Sequence
  Description of Artificial Sequence: Synthetic oligonucleotide
  modified_base (1)..(1): 2'-O-methyluridine-5'-phosphate
  modified_base (3)..(3): 2'-O-methylcytidine-5'-phosphate
  modified_base (6)..(6): 2'-O-methylcytidine-5'-phosphate
  modified_base (9)..(9): 2'-O-methyluridine-5'-phosphate
  modified_base (10)..(10): 2'-O-methylcytidine-5'-phosphate
  modified_base (17)..(17): 2'-O-methyluridine-5'-phosphate
  modified_base (21)..(21): 2'-deoxy-thymidine-5'-phosphate-phosphorothioate
nanaanaannggggagnggtt

SEQ ID NO: 200 - DNA, 21 bp, Artificial Sequence
  Description of Artificial Sequence: Synthetic oligonucleotide
  modified_base (2)..(2): 2'-O-methylcytidine-5'-phosphate
  modified_base (18)..(18): 2'-O-methyluridine-5'-phosphate
  modified_base (21)..(21): 2'-deoxy-thymidine-5'-phosphate-phosphorothioate
cnacuccccgauuguugnatt

SEQ ID NO: 201 - DNA, 21 bp, Artificial Sequence
  Description of Artificial Sequence: Synthetic oligonucleotide
  modified_base (5)..(5): 2'-O-methyluridine-5'-phosphate
  modified_base (6)..(7): 2'-O-methylcytidine-5'-phosphate
  modified_base (10)..(10): 2'-O-methylcytidine-5'-phosphate
  modified_base (12)..(12): 2'-O-methylcytidine-5'-phosphate
  modified_base (16)..(16): 2'-O-methylcytidine-5'-phosphate
  modified_base (17)..(18): 2'-O-methyluridine-5'-phosphate
  modified_base (19)..(19): 2'-O-methylcytidine-5'-phosphate
  modified_base (21)..(21): 2'-deoxy-thymidine-5'-phosphate-phosphorothioate
agagnnnggngngaannnntt

SEQ ID NO: 202 - DNA, 21 bp, Artificial Sequence
  Description of Artificial Sequence: Synthetic oligonucleotide
  modified_base (5)..(5): 2'-O-methyluridine-5'-phosphate
  modified_base (21)..(21): 2'-deoxy-thymidine-5'-phosphate-phosphorothioate
gaagnucgcgccggacucutt

SEQ ID NO: 203 - DNA, 21 bp, Artificial Sequence
  Description of Artificial Sequence: Synthetic oligonucleotide
  modified_base (1)..(1): 2'-O-methyluridine-5'-phosphate
  modified_base (5)..(5): 2'-O-methyluridine-5'-phosphate
  modified_base (7)..(8): 2'-O-methylcytidine-5'-phosphate
  modified_base (10)..(10): 2'-O-methyluridine-5'-phosphate
  modified_base (12)..(14): 2'-O-methyluridine-5'-phosphate
  modified_base (15)..(15): 2'-O-methylcytidine-5'-phosphate
  modified_base (19)..(19): 2'-O-methylcytidine-5'-phosphate
  modified_base (21)..(21): 2'-deoxy-thymidine-5'-phosphate-phosphorothioate
ngganannanannnngggntt

SEQ ID NO: 204 - DNA, 21 bp, Artificial Sequence
  Description of Artificial Sequence: Synthetic oligonucleotide
  modified_base (9)..(9): 2'-O-methyluridine-5'-phosphate
  modified_base (14)..(14): 2'-O-methyluridine-5'-phosphate
  modified_base (18)..(18): 2'-O-methylcytidine-5'-phosphate
  modified_base (21)..(21): 2'-deoxy-thymidine-5'-phosphate-phosphorothioate
gcccgaaanauggnaucnatt

SEQ ID NO: 205 - DNA, 21 bp, Artificial Sequence
  Description of Artificial Sequence: Synthetic oligonucleotide
  modified_base (1)..(1): 2'-O-methylcytidine-5'-phosphate
  modified_base (2)..(2): 2'-O-methyluridine-5'-phosphate
  modified_base (5)..(6): 2'-O-methylcytidine-5'-phosphate
  modified_base (9)..(9): 2'-O-methylcytidine-5'-phosphate
  modified_base (14)..(14): 2'-O-methylcytidine-5'-phosphate
  modified_base (17)..(17): 2'-O-methylcytidine-5'-phosphate
  modified_base (18)..(18): 2'-O-methyluridine-5'-phosphate
  modified_base (19)..(19): 2'-O-methylcytidine-5'-phosphate
  modified_base (21)..(21): 2'-deoxy-thymidine-5'-phosphate-phosphorothioate
nnggnnaangagangannntt

SEQ ID NO: 206 - DNA, 21 bp, Artificial Sequence
  Description of Artificial Sequence: Synthetic oligonucleotide
  modified_base (17)..(17): 2'-O-methylcytidine-5'-phosphate
  modified_base (21)..(21): 2'-deoxy-thymidine-5'-phosphate-phosphorothioate
gagucgucucguuggcnagtt

SEQ ID NO: 207 - DNA, 21 bp, Artificial Sequence
  Description of Artificial Sequence: Synthetic oligonucleotide
  modified_base (1)..(1): 2'-O-methyluridine-5'-phosphate
  modified_base (3)..(3): 2'-O-methyluridine-5'-phosphate
  modified_base (4)..(4): 2'-O-methylcytidine-5'-phosphate
  modified_base (6)..(6): 2'-O-methylcytidine-5'-phosphate
  modified_base (7)..(7): 2'-O-methyluridine-5'-phosphate
  modified_base (8)..(8): 2'-O-methylcytidine-5'-phosphate
  modified_base (10)..(10): 2'-O-methyluridine-5'-phosphate
  modified_base (13)..(13): 2'-O-methyluridine-5'-phosphate
  modified_base (15)..(15): 2'-O-methyluridine-5'-phosphate
  modified_base (18)..(19): 2'-O-methylcytidine-5'-phosphate
  modified_base (21)..(21): 2'-deoxy-thymidine-5'-phosphate-phosphorothioate
nanngnnngnaananaanntt

SEQ ID NO: 208 - DNA, 21 bp, Artificial Sequence
  Description of Artificial Sequence: Synthetic oligonucleotide
  modified_base (4)..(4): 2'-O-methyluridine-5'-phosphate
  modified_base (6)..(6): 2'-O-methyluridine-5'-phosphate
  modified_base (9)..(9): 2'-O-methyluridine-5'-phosphate
  modified_base (18)..(18): 2'-O-methyluridine-5'-phosphate
  modified_base (21)..(21): 2'-deoxy-thymidine-5'-phosphate-phosphorothioate
ggunanaunacgagcganatt

SEQ ID NO: 209 - DNA, 21 bp, Artificial Sequence
  Description of Artificial Sequence: Synthetic oligonucleotide
  modified_base (1)..(2): 2'-O-methyluridine-5'-phosphate
  modified_base (3)..(3): 2'-O-methylcytidine-5'-phosphate
  modified_base (7)..(7): 2'-O-methylcytidine-5'-phosphate
  modified_base (9)..(9): 2'-O-methylcytidine-5'-phosphate
  modified_base (12)..(12): 2'-O-methyluridine-5'-phosphate
  modified_base (13)..(13): 2'-O-methylcytidine-5'-phosphate
  modified_base (15)..(15): 2'-O-methyluridine-5'-phosphate
  modified_base (16)..(16): 2'-O-methylcytidine-5'-phosphate
  modified_base (18)..(18): 2'-O-methyluridine-5'-phosphate
  modified_base (19)..(19): 2'-O-methylcytidine-5'-phosphate
  modified_base (21)..(21): 2'-deoxy-thymidine-5'-phosphate-phosphorothioate
nnngagnangannannanntt

SEQ ID NO: 210 - DNA, 21 bp, Artificial Sequence
  Description of Artificial Sequence: Synthetic oligonucleotide
  modified_base (3)..(3): 2'-O-methyluridine-5'-phosphate
  modified_base (6)..(6): 2'-O-methyluridine-5'-phosphate
  modified_base (12)..(12): 2'-O-methyluridine-5'-phosphate
  modified_base (21)..(21): 2'-deoxy-thymidine-5'-phosphate-phosphorothioate
gangangaucgngcucgaatt

SEQ ID NO: 211 - DNA, 21 bp, Artificial Sequence
  Description of Artificial Sequence: Synthetic oligonucleotide
  modified_base (1)..(1): 2'-O-methylcytidine-5'-phosphate
  modified_base (2)..(2): 2'-O-methyluridine-5'-phosphate
  modified_base (3)..(3): 2'-O-methylcytidine-5'-phosphate
  modified_base (5)..(5): 2'-O-methylcytidine-5'-phosphate
  modified_base (7)..(7): 2'-O-methylcytidine-5'-phosphate
  modified_base (8)..(9): 2'-O-methyluridine-5'-phosphate
  modified_base (12)..(12): 2'-O-methylcytidine-5'-phosphate
  modified_base (16)..(16): 2'-O-methyluridine-5'-phosphate
  modified_base (17)..(18): 2'-O-methylcytidine-5'-phosphate
  modified_base (21)..(21): 2'-deoxy-thymidine-5'-phosphate-phosphorothioate
nnngngnnnagnaaannnatt

SEQ ID NO: 212 - DNA, 21 bp, Artificial Sequence
  Description of Artificial Sequence: Synthetic oligonucleotide
  modified_base (10)..(10): 2'-O-methyluridine-5'-phosphate
  modified_base (21)..(21): 2'-deoxy-thymidine-5'-phosphate-phosphorothioate
uggauuugcnaagcgcgagtt

SEQ ID NO: 213 - DNA, 21 bp, Artificial Sequence
  Description of Artificial Sequence: Synthetic oligonucleotide
  modified_base (1)..(2): 2'-O-methyluridine-5'-phosphate
  modified_base (4)..(4): 2'-O-methylcytidine-5'-phosphate
  modified_base (5)..(5): 2'-O-methyluridine-5'-phosphate
  modified_base (6)..(7): 2'-O-methylcytidine-5'-phosphate
  modified_base (8)..(8): 2'-O-methyluridine-5'-phosphate
  modified_base (10)..(10): 2'-O-methylcytidine-5'-phosphate
  modified_base (11)..(11): 2'-O-methyluridine-5'-phosphate
  modified_base (14)..(14): 2'-O-methyluridine-5'-phosphate
  modified_base (15)..(15): 2'-O-methylcytidine-5'-phosphate
  modified_base (17)..(19): 2'-O-methylcytidine-5'-phosphate
  modified_base (21)..(21): 2'-deoxy-thymidine-5'-phosphate-phosphorothioate
nnannnnnannaanngnnntt

SEQ ID NO: 214 - DNA, 21 bp, Artificial Sequence
  Description of Artificial Sequence: Synthetic oligonucleotide
  modified_base (8)..(8): 2'-O-methyluridine-5'-phosphate
  modified_base (11)..(11): 2'-O-methyluridine-5'-phosphate
  modified_base (17)..(17): 2'-O-methyluridine-5'-phosphate
  modified_base (21)..(21): 2'-deoxy-thymidine-5'-phosphate-phosphorothioate
gggcgaunagnaggagnaatt

SEQ ID NO: 215 - DNA, 21 bp, Artificial Sequence
  Description of Artificial Sequence: Synthetic oligonucleotide
  modified_base (1)..(1): 2'-O-methylcytidine-5'-phosphate
  modified_base (2)..(2): 2'-O-methyluridine-5'-phosphate
  modified_base (4)..(4): 2'-O-methylcytidine-5'-phosphate
  modified_base (8)..(9): 2'-O-methylcytidine-5'-phosphate
  modified_base (12)..(12): 2'-O-methyluridine-5'-phosphate
  modified_base (17)..(19): 2'-O-methyluridine-5'-phosphate
  modified_base (21)..(21): 2'-deoxy-thymidine-5'-phosphate-phosphorothioate
nngngaannggnagagnnntt

SEQ ID NO: 216 - DNA, 21 bp, Artificial Sequence
  Description of Artificial Sequence: Synthetic oligonucleotide
  modified_base (7)..(7): 2'-O-methyluridine-5'-phosphate
  modified_base (17)..(17): 2'-O-methylcytidine-5'-phosphate
  modified_base (21)..(21): 2'-deoxy-thymidine-5'-phosphate-phosphorothioate
aaacucnaccgguucgnagtt

SEQ ID NO: 217 - DNA, 21 bp, Artificial Sequence
  Description of Artificial Sequence: Synthetic oligonucleotide
  modified_base (1)..(2): 2'-O-methylcytidine-5'-phosphate
  modified_base (5)..(5): 2'-O-methyluridine-5'-phosphate
  modified_base (10)..(12): 2'-O-methyluridine-5'-phosphate
  modified_base (15)..(16): 2'-O-methyluridine-5'-phosphate
  modified_base (18)..(18): 2'-O-methylcytidine-5'-phosphate
  modified_base (21)..(21): 2'-deoxy-thymidine-5'-phosphate-phosphorothioate
nnggnagagnnnagnngnatt

SEQ ID NO: 218 - DNA, 21 bp, Artificial Sequence
  Description of Artificial Sequence: Synthetic oligonucleotide
  modified_base (3)..(3): 2'-O-methylcytidine-5'-phosphate
  modified_base (7)..(7): 2'-O-methyluridine-5'-phosphate
  modified_base (14)..(14): 2'-O-methyluridine-5'-phosphate
  modified_base (21)..(21): 2'-deoxy-thymidine-5'-phosphate-phosphorothioate
ugnaacnaaacucnaccggtt

SEQ ID NO: 219 - DNA, 21 bp, Artificial Sequence
  Description of Artificial Sequence: Synthetic oligonucleotide
  modified_base (2)..(2): 2'-O-methyluridine-5'-phosphate
  modified_base (4)..(5): 2'-O-methyluridine-5'-phosphate
  modified_base (6)..(6): 2'-O-methylcytidine-5'-phosphate
  modified_base (10)..(10): 2'-O-methylcytidine-5'-phosphate
  modified_base (12)..(12): 2'-O-methylcytidine-5'-phosphate
  modified_base (15)..(15): 2'-O-methyluridine-5'-phosphate
  modified_base (16)..(16): 2'-O-methylcytidine-5'-phosphate
  modified_base (18)..(18): 2'-O-methyluridine-5'-phosphate
  modified_base (19)..(19): 2'-O-methylcytidine-5'-phosphate
  modified_base (21)..(21): 2'-deoxy-thymidine-5'-phosphate-phosphorothioate
angnnngagnangannanntt

SEQ ID NO: 220 - DNA, 21 bp, Artificial Sequence
  Description of Artificial Sequence: Synthetic oligonucleotide
  modified_base (17)..(17): 2'-O-methylcytidine-5'-phosphate
  modified_base (21)..(21): 2'-deoxy-thymidine-5'-phosphate-phosphorothioate
gaugaucgugcucgaanautt

SEQ ID NO: 221 - DNA, 21 bp, Artificial Sequence
  Description of Artificial Sequence: Synthetic oligonucleotide
  modified_base (3)..(4): 2'-O-methyluridine-5'-phosphate
  modified_base (6)..(6): 2'-O-methyluridine-5'-phosphate
  modified_base (7)..(7): 2'-O-methylcytidine-5'-phosphate
  modified_base (12)..(12): 2'-O-methyluridine-5'-phosphate
  modified_base (16)..(16): 2'-O-methyluridine-5'-phosphate
  modified_base (18)..(19): 2'-O-methylcytidine-5'-phosphate
  modified_base (21)..(21): 2'-deoxy-thymidine-5'-phosphate-phosphorothioate
aannanngaggngagnanntt

SEQ ID NO: 222 - DNA, 21 bp, Artificial Sequence
  Description of Artificial Sequence: Synthetic oligonucleotide
  modified_base (3)..(3): 2'-O-methyluridine-5'-phosphate
  modified_base (7)..(7): 2'-O-methylcytidine-5'-phosphate
  modified_base (15)..(15): 2'-O-methyluridine-5'-phosphate
  modified_base (21)..(21): 2'-deoxy-thymidine-5'-phosphate-phosphorothioate
ggnacunaccucganaauutt

SEQ ID NO: 223 - DNA, 21 bp, Artificial Sequence
  Description of Artificial Sequence: Synthetic oligonucleotide
  modified_base (5)..(6): 2'-O-methylcytidine-5'-phosphate
  modified_base (9)..(9): 2'-O-methylcytidine-5'-phosphate
  modified_base (12)..(12): 2'-O-methyluridine-5'-phosphate
  modified_base (13)..(15): 2'-O-methylcytidine-5'-phosphate
  modified_base (16)..(16): 2'-O-methyluridine-5'-phosphate
  modified_base (19)..(19): 2'-O-methyluridine-5'-phosphate
  modified_base (21)..(21): 2'-deoxy-thymidine-5'-phosphate-phosphorothioate
gggannganaannnnnaantt

SEQ ID NO: 224 - DNA, 21 bp, Artificial Sequence
  Description of Artificial Sequence: Synthetic oligonucleotide
  modified_base (3)..(3): 2'-O-methyluridine-5'-phosphate
  modified_base (21)..(21): 2'-deoxy-thymidine-5'-phosphate-phosphorothioate
aunagggauugucgguccctt

SEQ ID NO: 225 - DNA, 21 bp, Artificial Sequence
  Description of Artificial Sequence: Synthetic oligonucleotide
  modified_base (1)..(1): 2'-O-methyluridine-5'-phosphate
  modified_base (2)..(2): 2'-O-methylcytidine-5'-phosphate
  modified_base (4)..(4): 2'-O-methyluridine-5'-phosphate
  modified_base (6)..(6): 2'-O-methyluridine-5'-phosphate
  modified_base (7)..(7): 2'-O-methylcytidine-5'-phosphate
  modified_base (9)..(9): 2'-O-methylcytidine-5'-phosphate
  modified_base (10)..(10): 2'-O-methyluridine-5'-phosphate
  modified_base (11)..(11): 2'-O-methylcytidine-5'-phosphate
  modified_base (13)..(13): 2'-O-methyluridine-5'-phosphate
  modified_base (16)..(16): 2'-O-methyluridine-5'-phosphate
  modified_base (18)..(18): 2'-O-methyluridine-5'-phosphate
  modified_base (21)..(21): 2'-deoxy-thymidine-5'-phosphate-phosphorothioate
nngnanngnnngnaananatt

SEQ ID NO: 226 - DNA, 21 bp, Artificial Sequence
  Description of Artificial Sequence: Synthetic oligonucleotide
  modified_base (1)..(1): 2'-O-methyluridine-5'-phosphate
  modified_base (3)..(3): 2'-O-methyluridine-5'-phosphate
  modified_base (6)..(6): 2'-O-methyluridine-5'-phosphate
  modified_base (15)..(15): 2'-O-methyluridine-5'-phosphate
  modified_base (21)..(21): 2'-deoxy-thymidine-5'-phosphate-phosphorothioate
nanaunacgagcganacgatt

SEQ ID NO: 227 - DNA, 21 bp, Artificial Sequence
  Description of Artificial Sequence: Synthetic oligonucleotide
  modified_base (2)..(2): 2'-O-methyluridine-5'-phosphate
  modified_base (6)..(6): 2'-O-methyluridine-5'-phosphate
  modified_base (8)..(9): 2'-O-methylcytidine-5'-phosphate
  modified_base (11)..(11): 2'-O-methyluridine-5'-phosphate
  modified_base (12)..(12): 2'-O-methylcytidine-5'-phosphate
  modified_base (15)..(15): 2'-O-methyluridine-5'-phosphate
  modified_base (16)..(16): 2'-O-methylcytidine-5'-phosphate
  modified_base (21)..(21): 2'-deoxy-thymidine-5'-phosphate-phosphorothioate
gngagnanngnnaannaagtt

SEQ ID NO: 228 - DNA, 21 bp, Artificial Sequence
  Description of Artificial Sequence: Synthetic oligonucleotide
  modified_base (13)..(13): 2'-O-methyluridine-5'-phosphate
  modified_base (17)..(17): 2'-O-methylcytidine-5'-phosphate
  modified_base (21)..(21): 2'-deoxy-thymidine-5'-phosphate-phosphorothioate
cuugauugacggnacunactt

SEQ ID NO: 229 - DNA, 21 bp, Artificial Sequence
  Description of Artificial Sequence: Synthetic oligonucleotide
  modified_base (3)..(3): 2'-O-methyluridine-5'-phosphate
  modified_base (4)..(4): 2'-O-methylcytidine-5'-phosphate
  modified_base (5)..(5): 2'-O-methyluridine-5'-phosphate
  modified_base (7)..(7): 2'-O-methylcytidine-5'-phosphate
  modified_base (11)..(12): 2'-O-methylcytidine-5'-phosphate
  modified_base (15)..(15): 2'-O-methyluridine-5'-phosphate
  modified_base (21)..(21): 2'-deoxy-thymidine-5'-phosphate-phosphorothioate
gannngngaannggnagagtt

SEQ ID NO: 230 - DNA, 21 bp, Artificial Sequence
  Description of Artificial Sequence: Synthetic oligonucleotide
  modified_base (4)..(4): 2'-O-methyluridine-5'-phosphate
  modified_base (14)..(14): 2'-O-methylcytidine-5'-phosphate
  modified_base (21)..(21): 2'-deoxy-thymidine-5'-phosphate-phosphorothioate
cucnaccgguucgnagauctt

SEQ ID NO: 231 - DNA, 21 bp, Artificial Sequence
  Description of Artificial Sequence: Synthetic oligonucleotide
  modified_base (2)..(2): 2'-O-methyluridine-5'-phosphate
  modified_base (3)..(3): 2'-O-methylcytidine-5'-phosphate
  modified_base (4)..(4): 2'-O-methyluridine-5'-phosphate
  modified_base (6)..(6): 2'-O-methylcytidine-5'-phosphate
  modified_base (10)..(11): 2'-O-methylcytidine-5'-phosphate
  modified_base (14)..(14): 2'-O-methyluridine-5'-phosphate
  modified_base (19)..(19): 2'-O-methyluridine-5'-phosphate
  modified_base (21)..(21): 2'-deoxy-thymidine-5'-phosphate-phosphorothioate
annngngaannggnagagntt

SEQ ID NO: 232 - DNA, 21 bp, Artificial Sequence
  Description of Artificial Sequence: Synthetic oligonucleotide
  modified_base (5)..(5): 2'-O-methyluridine-5'-phosphate
  modified_base (15)..(15): 2'-O-methylcytidine-5'-phosphate
  modified_base (21)..(21): 2'-deoxy-thymidine-5'-phosphate-phosphorothioate
acucnaccgguucgnagautt

SEQ ID NO: 233 - DNA, 21 bp, Artificial Sequence
  Description of Artificial Sequence: Synthetic oligonucleotide
  modified_base (1)..(1): 2'-O-methyluridine-5'-phosphate
  modified_base (2)..(2): 2'-O-methylcytidine-5'-phosphate
  modified_base (3)..(3): 2'-O-methyluridine-5'-phosphate
  modified_base (4)..(4): 2'-O-methylcytidine-5'-phosphate
  modified_base (6)..(6): 2'-O-methyluridine-5'-phosphate
  modified_base (8)..(8): 2'-O-methyluridine-5'-phosphate
  modified_base (9)..(9): 2'-O-methylcytidine-5'-phosphate
  modified_base (11)..(11): 2'-O-methylcytidine-5'-phosphate
  modified_base (12)..(12): 2'-O-methyluridine-5'-phosphate
  modified_base (13)..(13): 2'-O-methylcytidine-5'-phosphate
  modified_base (15)..(15): 2'-O-methyluridine-5'-phosphate
  modified_base (18)..(18): 2'-O-methyluridine-5'-phosphate
  modified_base (21)..(21): 2'-deoxy-thymidine-5'-phosphate-phosphorothioate
nnnngnanngnnngnaanatt

SEQ ID NO: 234 - DNA, 21 bp, Artificial Sequence
  Description of Artificial Sequence: Synthetic oligonucleotide
  modified_base (1)..(1): 2'-O-methyluridine-5'-phosphate
  modified_base (4)..(4): 2'-O-methyluridine-5'-phosphate
  modified_base (13)..(13): 2'-O-methyluridine-5'-phosphate
  modified_base (21)..(21): 2'-deoxy-thymidine-5'-phosphate-phosphorothioate
naunacgagcganacgagatt

SEQ ID NO: 235 - DNA, 21 bp, Artificial Sequence
  Description of Artificial Sequence: Synthetic oligonucleotide
  modified_base (3)..(4): 2'-O-methyluridine-5'-phosphate
  modified_base (6)..(6): 2'-O-methylcytidine-5'-phosphate
  modified_base (9)..(10): 2'-O-methylcytidine-5'-phosphate
  modified_base (11)..(11): 2'-O-methyluridine-5'-phosphate
  modified_base (14)..(14): 2'-O-methylcytidine-5'-phosphate
  modified_base (16)..(16): 2'-O-methylcytidine-5'-phosphate
  modified_base (18)..(18): 2'-O-methylcytidine-5'-phosphate
  modified_base (21)..(21): 2'-deoxy-thymidine-5'-phosphate-phosphorothioate
agnngnaannnaanananatt

SEQ ID NO: 236 - DNA, 21 bp, Artificial Sequence
  Description of Artificial Sequence: Synthetic oligonucleotide
  modified_base (8)..(8): 2'-O-methyluridine-5'-phosphate
  modified_base (15)..(15): 2'-O-methylcytidine-5'-phosphate
  modified_base (21)..(21): 2'-deoxy-thymidine-5'-phosphate-phosphorothioate
ugugugunagguugnaacutt

SEQ ID NO: 237 - DNA, 21 bp, Artificial Sequence
  Description of Artificial Sequence: Synthetic oligonucleotide
  modified_base (1)..(1): 2'-O-methyluridine-5'-phosphate
  modified_base (3)..(4): 2'-O-methyluridine-5'-phosphate
  modified_base (5)..(5): 2'-O-methylcytidine-5'-phosphate
  modified_base (9)..(9): 2'-O-methylcytidine-5'-phosphate
  modified_base (11)..(11): 2'-O-methylcytidine-5'-phosphate
  modified_base (14)..(14): 2'-O-methyluridine-5'-phosphate
  modified_base (15)..(15): 2'-O-methylcytidine-5'-phosphate
  modified_base (17)..(17): 2'-O-methyluridine-5'-phosphate
  modified_base (18)..(18): 2'-O-methylcytidine-5'-phosphate
  modified_base (21)..(21): 2'-deoxy-thymidine-5'-phosphate-phosphorothioate
ngnnngagnangannannatt

SEQ ID NO: 238 - DNA, 21 bp, Artificial Sequence
  Description of Artificial Sequence: Synthetic oligonucleotide
  modified_base (18)..(18): 2'-O-methylcytidine-5'-phosphate
  modified_base (21)..(21): 2'-deoxy-thymidine-5'-phosphate-phosphorothioate
ugaugaucgugcucgaanatt

SEQ ID NO: 239 - DNA, 21 bp, Artificial Sequence
  Description of Artificial Sequence: Synthetic oligonucleotide
  modified_base (1)..(1): 2'-O-methylcytidine-5'-phosphate
  modified_base (3)..(3): 2'-O-methylcytidine-5'-phosphate
  modified_base (7)..(7): 2'-O-methyluridine-5'-phosphate
  modified_base (9)..(9): 2'-O-methylcytidine-5'-phosphate
  modified_base (11)..(11): 2'-O-methylcytidine-5'-phosphate
  modified_base (13)..(14): 2'-O-methyluridine-5'-phosphate
  modified_base (15)..(16): 2'-O-methylcytidine-5'-phosphate
  modified_base (17)..(17): 2'-O-methyluridine-5'-phosphate
  modified_base (19)..(19): 2'-O-methylcytidine-5'-phosphate
  modified_base (21)..(21): 2'-deoxy-thymidine-5'-phosphate-phosphorothioate
nanaagngngngnnnnnantt

SEQ ID NO: 240 - DNA, 21 bp, Artificial Sequence
  Description of Artificial Sequence: Synthetic oligonucleotide
  modified_base (2)..(2): 2'-O-methyluridine-5'-phosphate
  modified_base (12)..(12): 2'-O-methylcytidine-5'-phosphate
  modified_base (21)..(21): 2'-deoxy-thymidine-5'-phosphate-phosphorothioate
gnaggaacgcgnacuugugtt

SEQ ID NO: 241 - DNA, 21 bp, Artificial Sequence
  Description of Artificial Sequence: Synthetic oligonucleotide
  modified_base (2)..(2): 2'-O-methylcytidine-5'-phosphate
  modified_base (6)..(6): 2'-O-methyluridine-5'-phosphate
  modified_base (8)..(8): 2'-O-methylcytidine-5'-phosphate
  modified_base (10)..(10): 2'-O-methylcytidine-5'-phosphate
  modified_base (12)..(13): 2'-O-methyluridine-5'-phosphate
  modified_base (14)..(15): 2'-O-methylcytidine-5'-phosphate
  modified_base (16)..(16): 2'-O-methyluridine-5'-phosphate
  modified_base (18)..(18): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
anaagngngngnnnnnanntt

SEQ ID NO: 242 - DNA, 21 bp, Artificial Sequence
  Description of Artificial Sequence: Synthetic oligonucleotide
  modified_base (3)..(3): 2'-O-methyluridine-5'-phosphate
  modified_base (13)..(13): 2'-O-methylcytidine-5'-phosphate
  modified_base (21)..(21): 2'-deoxy-thymidine-5'-phosphate-phosphorothioate
agnaggaacgcgnacuugutt

SEQ ID NO: 243 - DNA, 21 bp, Artificial Sequence
  Description of Artificial Sequence: Synthetic oligonucleotide
  modified_base (2)..(3): 2'-O-methyluridine-5'-phosphate
  modified_base (5)..(5): 2'-O-methylcytidine-5'-phosphate
  modified_base (6)..(6): 2'-O-methyluridine-5'-phosphate
  modified_base (7)..(8): 2'-O-methylcytidine-5'-phosphate
  modified_base (9)..(9): 2'-O-methyluridine-5'-phosphate
  modified_base (11)..(11): 2'-O-methylcytidine-5'-phosphate
  modified_base (12)..(12): 2'-O-methyluridine-5'-phosphate
  modified_base (15)..(15): 2'-O-methyluridine-5'-phosphate
  modified_base (16)..(16): 2'-O-methylcytidine-5'-phosphate
  modified_base (18)..(19): 2'-O-methylcytidine-5'-phosphate
  modified_base (21)..(21): 2'-deoxy-thymidine-5'-phosphate-phosphorothioate
annannnnnannaanngnntt

SEQ ID NO: 244 - DNA, 21 bp, Artificial Sequence
  Description of Artificial Sequence: Synthetic oligonucleotide
  modified_base (7)..(7): 2'-O-methyluridine-5'-phosphate
  modified_base (10)..(10): 2'-O-methyluridine-5'-phosphate
  modified_base (16)..(16): 2'-O-methyluridine-5'-phosphate
  modified_base (21)..(21): 2'-deoxy-thymidine-5'-phosphate-phosphorothioate
ggcgaunagnaggagnaautt

SEQ ID NO: 245 - DNA, 21 bp, Artificial Sequence
  Description of Artificial Sequence: Synthetic oligonucleotide
  modified_base (1)..(1): 2'-O-methyluridine-5'-phosphate
  modified_base (3)..(3): 2'-O-methylcytidine-5'-phosphate
  modified_base (4)..(4): 2'-O-methyluridine-5'-phosphate
  modified_base (5)..(6): 2'-O-methylcytidine-5'-phosphate
  modified_base (7)..(7): 2'-O-methyluridine-5'-phosphate
  modified_base (9)..(9): 2'-O-methylcytidine-5'-phosphate
  modified_base (10)..(10): 2'-O-methyluridine-5'-phosphate
  modified_base (13)..(13): 2'-O-methyluridine-5'-phosphate
  modified_base (14)..(14): 2'-O-methylcytidine-5'-phosphate
  modified_base (16)..(18): 2'-O-methylcytidine-5'-phosphate
  modified_base (21)..(21): 2'-deoxy-thymidine-5'-phosphate-phosphorothioate
nannnnnannaanngnnngtt

SEQ ID NO: 246 - DNA, 21 bp, Artificial Sequence
  Description of Artificial Sequence: Synthetic oligonucleotide
  modified_base (9)..(9): 2'-O-methyluridine-5'-phosphate
  modified_base (12)..(12): 2'-O-methyluridine-5'-phosphate
  modified_base (18)..(18): 2'-O-methyluridine-5'-phosphate
  modified_base (21)..(21): 2'-deoxy-thymidine-5'-phosphate-phosphorothioate
cgggcgaunagnaggagnatt

SEQ ID NO: 247 - DNA, 21 bp, Artificial Sequence
  Description of Artificial Sequence: Synthetic oligonucleotide
  modified_base (1)..(2): 2'-O-methylcytidine-5'-phosphate
  modified_base (3)..(3): 2'-O-methyluridine-5'-phosphate
  modified_base (5)..(5): 2'-O-methylcytidine-5'-phosphate
  modified_base (6)..(6): 2'-O-methyluridine-5'-phosphate
  modified_base (9)..(9): 2'-O-methyluridine-5'-phosphate
  modified_base (10)..(10): 2'-O-methylcytidine-5'-phosphate
  modified_base (12)..(14): 2'-O-methylcytidine-5'-phosphate
  modified_base (16)..(16): 2'-O-methyluridine-5'-phosphate
  modified_base (21)..(21): 2'-deoxy-thymidine-5'-phosphate-phosphorothioate
nnnannaanngnnngnaagtt

SEQ ID NO: 248 - DNA, 21 bp, Artificial Sequence
  Description of Artificial Sequence: Synthetic oligonucleotide
  modified_base (3)..(3): 2'-O-methyluridine-5'-phosphate
  modified_base (13)..(13): 2'-O-methyluridine-5'-phosphate
  modified_base (16)..(16): 2'-O-methyluridine-5'-phosphate
  modified_base (21)..(21): 2'-deoxy-thymidine-5'-phosphate-phosphorothioate
cunacgggcgaunagnaggtt

SEQ ID NO: 249 - DNA, 21 bp, Artificial Sequence
  Description of Artificial Sequence: Synthetic oligonucleotide
  modified_base (1)..(1): 2'-O-methylcytidine-5'-phosphate
  modified_base (2)..(2): 2'-O-methyluridine-5'-phosphate
  modified_base (4)..(4): 2'-O-methylcytidine-5'-phosphate
  modified_base (5)..(5): 2'-O-methyluridine-5'-phosphate
  modified_base (8)..(8): 2'-O-methyluridine-5'-phosphate
  modified_base (9)..(9): 2'-O-methylcytidine-5'-phosphate
  modified_base (11)..(13): 2'-O-methylcytidine-5'-phosphate
  modified_base (15)..(15): 2'-O-methyluridine-5'-phosphate
  modified_base (21)..(21): 2'-deoxy-thymidine-5'-phosphate-phosphorothioate
nnannaanngnnngnaagatt

SEQ ID NO: 250 - DNA, 21 bp, Artificial Sequence
  Description of Artificial Sequence: Synthetic oligonucleotide
  modified_base (4)..(4): 2'-O-methyluridine-5'-phosphate
  modified_base (14)..(14): 2'-O-methyluridine-5'-phosphate
  modified_base (17)..(17): 2'-O-methyluridine-5'-phosphate
  modified_base (21)..(21): 2'-deoxy-thymidine-5'-phosphate-phosphorothioate
ucunacgggcgaunagnagtt

SEQ ID NO: 251 - DNA, 21 bp, Artificial Sequence
  Description of Artificial Sequence: Synthetic oligonucleotide
  modified_base (1)..(1): 2'-O-methylcytidine-5'-phosphate
  modified_base (7)..(7): 2'-O-methylcytidine-5'-phosphate
  modified_base (8)..(8): 2'-O-methyluridine-5'-phosphate
  modified_base (9)..(9): 2'-O-methylcytidine-5'-phosphate
  modified_base (11)..(11): 2'-O-methylcytidine-5'-phosphate
  modified_base (13)..(13): 2'-O-methylcytidine-5'-phosphate
  modified_base (14)..(15): 2'-O-methyluridine-5'-phosphate
  modified_base (18)..(18): 2'-O-methylcytidine-5'-phosphate
  modified_base (21)..(21): 2'-deoxy-thymidine-5'-phosphate-phosphorothioate
naaggannngngnnnagnatt

SEQ ID NO: 252 - DNA, 21 bp, Artificial Sequence
  Description of Artificial Sequence: Synthetic oligonucleotide
  modified_base (4)..(4): 2'-O-methyluridine-5'-phosphate
  modified_base (21)..(21): 2'-deoxy-thymidine-5'-phosphate-phosphorothioate
ugcnaagcgcgaguccuugtt

SEQ ID NO: 253 - DNA, 21 bp, Artificial Sequence
  Description of Artificial Sequence: Synthetic oligonucleotide
  modified_base (3)..(3): 2'-O-methylcytidine-5'-phosphate
  modified_base (4)..(4): 2'-O-methyluridine-5'-phosphate
  modified_base (6)..(6): 2'-O-methylcytidine-5'-phosphate
  modified_base (11)..(11): 2'-O-methylcytidine-5'-phosphate
  modified_base (14)..(14): 2'-O-methyluridine-5'-phosphate
  modified_base (16)..(16): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
agnnangggangananaantt

SEQ ID NO: 254 - DNA, 21 bp, Artificial Sequence
  Description of Artificial Sequence: Synthetic oligonucleotide
  modified_base (5)..(5): 2'-O-methyluridine-5'-phosphate
  modified_base (15)..(15): 2'-O-methyluridine-5'-phosphate
  modified_base (21)..(21): 2'-deoxy-thymidine-5'-phosphate-phosphorothioate
auugnaucgucccgnagcutt

SEQ ID NO: 255 - DNA, 21 bp, Artificial Sequence
  Description of Artificial Sequence: Synthetic oligonucleotide
  modified_base (2)..(2): 2'-O-methyluridine-5'-phosphate
  modified_base (3)..(3): 2'-O-methylcytidine-5'-phosphate
  modified_base (5)..(6): 2'-O-methyluridine-5'-phosphate
  modified_base (9)..(10): 2'-O-methyluridine-5'-phosphate
  modified_base (11)..(11): 2'-O-methylcytidine-5'-phosphate
  modified_base (14)..(14): 2'-O-methyluridine-5'-phosphate
  modified_base (15)..(16): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
gnngnngannngannnaantt

SEQ ID NO: 256 - DNA, 21 bp, Artificial Sequence
  Description of Artificial Sequence: Synthetic oligonucleotide
  modified_base (13)..(13): 2'-O-methylcytidine-5'-phosphate
  modified_base (21)..(21): 2'-deoxy-thymidine-5'-phosphate-phosphorothioate
auuggaucgaaunaacgactt

SEQ ID NO: 257 - DNA, 21 bp, Artificial Sequence
  Description of Artificial Sequence: Synthetic oligonucleotide
  modified_base (5)..(5): 2'-O-methylcytidine-5'-phosphate
  modified_base (6)..(6): 2'-O-methyluridine-5'-phosphate
  modified_base (8)..(8): 2'-O-methylcytidine-5'-phosphate
  modified_base (13)..(13): 2'-O-methylcytidine-5'-phosphate
  modified_base (16)..(16): 2'-O-methyluridine-5'-phosphate
  modified_base (18)..(18): 2'-O-methylcytidine-5'-phosphate
  modified_base (21)..(21): 2'-deoxy-thymidine-5'-phosphate-phosphorothioate
aaagnnangggangananatt

SEQ ID NO: 258 - DNA, 21 bp, Artificial Sequence
  Description of Artificial Sequence: Synthetic oligonucleotide
  modified_base (3)..(3): 2'-O-methyluridine-5'-phosphate
  modified_base (13)..(13): 2'-O-methyluridine-5'-phosphate
  modified_base (21)..(21): 2'-deoxy-thymidine-5'-phosphate-phosphorothioate
ugnaucgucccgnagcuuutt

SEQ ID NO: 259 - DNA, 21 bp, Artificial Sequence
  Description of Artificial Sequence: Synthetic oligonucleotide
  modified_base (1)..(1): 2'-O-methylcytidine-5'-phosphate
  modified_base (4)..(4): 2'-O-methylcytidine-5'-phosphate
  modified_base (6)..(6): 2'-O-methyluridine-5'-phosphate
  modified_base (8)..(8): 2'-O-methylcytidine-5'-phosphate
  modified_base (12)..(12): 2'-O-methylcytidine-5'-phosphate
  modified_base (14)..(14): 2'-O-methylcytidine-5'-phosphate
  modified_base (17)..(17): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
naanangngaananaangntt

SEQ ID NO: 260 - DNA, 21 bp, Artificial Sequence
  Description of Artificial Sequence: Synthetic oligonucleotide
  modified_base (13)..(13): 2'-O-methylcytidine-5'-phosphate
  modified_base (21)..(21): 2'-deoxy-thymidine-5'-phosphate-phosphorothioate
acguuguguucgnauguugtt

SEQ ID NO: 261 - DNA, 21 bp, Artificial Sequence
  Description of Artificial Sequence: Synthetic oligonucleotide
  modified_base (1)..(1): 2'-O-methyluridine-5'-phosphate
  modified_base (6)..(6): 2'-O-methylcytidine-5'-phosphate
  modified_base (7)..(7): 2'-O-methyluridine-5'-phosphate
  modified_base (9)..(9): 2'-O-methylcytidine-5'-phosphate
  modified_base (14)..(14): 2'-O-methylcytidine-5'-phosphate
  modified_base (17)..(17): 2'-O-methyluridine-5'-phosphate
  modified_base (19)..(19): 2'-O-methylcytidine-5'-phosphate
  modified_base (21)..(21): 2'-deoxy-thymidine-5'-phosphate-phosphorothioate
naaagnnanggganganantt

SEQ ID NO: 262 - DNA, 21 bp, Artificial Sequence
  Description of Artificial Sequence: Synthetic oligonucleotide
  modified_base (2)..(2): 2'-O-methyluridine-5'-phosphate
  modified_base (12)..(12): 2'-O-methyluridine-5'-phosphate
  modified_base (18)..(18): 2'-O-methyluridine-5'-phosphate
  modified_base (21)..(21): 2'-deoxy-thymidine-5'-phosphate-phosphorothioate
gnaucgucccgnagcuunatt

SEQ ID NO: 263 - DNA, 21 bp, Artificial Sequence
  Description of Artificial Sequence: Synthetic oligonucleotide
  modified_base (1)..(1): 2'-O-methyluridine-5'-phosphate
  modified_base (3)..(3): 2'-O-methyluridine-5'-phosphate
  modified_base (4)..(4): 2'-O-methylcytidine-5'-phosphate
  modified_base (5)..(6): 2'-O-methyluridine-5'-phosphate
  modified_base (10)..(10): 2'-O-methylcytidine-5'-phosphate
  modified_base (13)..(14): 2'-O-methylcytidine-5'-phosphate
  modified_base (15)..(15): 2'-O-methyluridine-5'-phosphate
  modified_base (16)..(16): 2'-O-methylcytidine-5'-phosphate
  modified_base (17)..(17): 2'-O-methyluridine-5'-phosphate
  modified_base (19)..(19): 2'-O-methyluridine-5'-phosphate
  modified_base (21)..(21): 2'-deoxy-thymidine-5'-phosphate-phosphorothioate
ngnnnnaagngannnnngntt

SEQ ID NO: 264 - DNA, 21 bp, Artificial Sequence
  Description of Artificial Sequence: Synthetic oligonucleotide
  modified_base (2)..(2): 2'-O-methylcytidine-5'-phosphate
  modified_base (13)..(13): 2'-O-methyluridine-5'-phosphate
  modified_base (18)..(18): 2'-O-methylcytidine-5'-phosphate
  modified_base (21)..(21): 2'-deoxy-thymidine-5'-phosphate-phosphorothioate
anagaggucgcunaaganatt

SEQ ID NO: 265 - DNA, 21 bp, Artificial Sequence
  Description of Artificial Sequence: Synthetic oligonucleotide
  modified_base (1)..(1): 2'-O-methyluridine-5'-phosphate
  modified_base (2)..(2): 2'-O-methylcytidine-5'-phosphate
  modified_base (3)..(3): 2'-O-methyluridine-5'-phosphate
  modified_base (5)..(5): 2'-O-methylcytidine-5'-phosphate
  modified_base (7)..(7): 2'-O-methyluridine-5'-phosphate
  modified_base (9)..(9): 2'-O-methyluridine-5'-phosphate
  modified_base (10)..(10): 2'-O-methylcytidine-5'-phosphate
  modified_base (12)..(12): 2'-O-methyluridine-5'-phosphate
  modified_base (16)..(16): 2'-O-methylcytidine-5'-phosphate
  modified_base (17)..(17): 2'-O-methyluridine-5'-phosphate
  modified_base (19)..(19): 2'-O-methylcytidine-5'-phosphate
  modified_base (21)..(21): 2'-deoxy-thymidine-5'-phosphate-phosphorothioate
nnnanangnngngaannantt

SEQ ID NO: 266 - DNA, 21 bp, Artificial Sequence
  Description of Artificial Sequence: Synthetic oligonucleotide
  modified_base (2)..(2): 2'-O-methyluridine-5'-phosphate
  modified_base (7)..(7): 2'-O-methylcytidine-5'-phosphate
  modified_base (12)..(12): 2'-O-methylcytidine-5'-phosphate
  modified_base (16)..(16): 2'-O-methyluridine-5'-phosphate
  modified_base (21)..(21): 2'-deoxy-thymidine-5'-phosphate-phosphorothioate
gnaguunacganaugnagatt

SEQ ID NO: 267 - DNA, 21 bp, Artificial Sequence
  Description of Artificial Sequence: Synthetic oligonucleotide
  modified_base (1)..(1): 2'-O-methylcytidine-5'-phosphate
  modified_base (2)..(2): 2'-O-methyluridine-5'-phosphate
  modified_base (4)..(4): 2'-O-methylcytidine-5'-phosphate
  modified_base (6)..(6): 2'-O-methyluridine-5'-phosphate
  modified_base (8)..(8): 2'-O-methyluridine-5'-phosphate
  modified_base (9)..(9): 2'-O-methylcytidine-5'-phosphate
  modified_base (11)..(11): 2'-O-methyluridine-5'-phosphate
  modified_base (15)..(15): 2'-O-methylcytidine-5'-phosphate
  modified_base (16)..(16): 2'-O-methyluridine-5'-phosphate
  modified_base (18)..(18): 2'-O-methylcytidine-5'-phosphate
  modified_base (21)..(21): 2'-deoxy-thymidine-5'-phosphate-phosphorothioate
nnanangnngngaannanatt

SEQ ID NO: 268 - DNA, 21 bp, Artificial Sequence
  Description of Artificial Sequence: Synthetic oligonucleotide
  modified_base (3)..(3): 2'-O-methyluridine-5'-phosphate
  modified_base (8)..(8): 2'-O-methylcytidine-5'-phosphate
  modified_base (13)..(13): 2'-O-methylcytidine-5'-phosphate
  modified_base (17)..(17): 2'-O-methyluridine-5'-phosphate
  modified_base (21)..(21): 2'-deoxy-thymidine-5'-phosphate-phosphorothioate
ugnaguunacganaugnagtt

SEQ ID NO: 269 - DNA, 21 bp, Artificial Sequence
  Description of Artificial Sequence: Synthetic oligonucleotide
  modified_base (3)..(3): 2'-O-methylcytidine-5'-phosphate
  modified_base (4)..(4): 2'-O-methyluridine-5'-phosphate
  modified_base (6)..(6): 2'-O-methylcytidine-5'-phosphate
  modified_base (9)..(9): 2'-O-methylcytidine-5'-phosphate
  modified_base (13)..(14): 2'-O-methyluridine-5'-phosphate
  modified_base (16)..(17): 2'-O-methyluridine-5'-phosphate
  modified_base (21)..(21): 2'-deoxy-thymidine-5'-phosphate-phosphorothioate
aannanaangganngnngatt

SEQ ID NO: 270 - DNA, 21 bp, Artificial Sequence
  Description of Artificial Sequence: Synthetic oligonucleotide
  modified_base (2)..(2): 2'-O-methylcytidine-5'-phosphate
  modified_base (5)..(5): 2'-O-methylcytidine-5'-phosphate
  modified_base (15)..(15): 2'-O-methyluridine-5'-phosphate
  modified_base (21)..(21): 2'-deoxy-thymidine-5'-phosphate-phosphorothioate
unaanaauccguugnaguutt

SEQ ID NO: 271 - DNA, 21 bp, Artificial Sequence
  Description of Artificial Sequence: Synthetic oligonucleotide
  modified_base (1)..(2): 2'-O-methylcytidine-5'-phosphate
  modified_base (5)..(5): 2'-O-methylcytidine-5'-phosphate
  modified_base (9)..(9): 2'-O-methyluridine-5'-phosphate
  modified_base (10)..(10): 2'-O-methylcytidine-5'-phosphate
  modified_base (13)..(13): 2'-O-methylcytidine-5'-phosphate
  modified_base (16)..(16): 2'-O-methyluridine-5'-phosphate
  modified_base (21)..(21): 2'-deoxy-thymidine-5'-phosphate-phosphorothioate
nnganaaannggnaangaatt

SEQ ID NO: 272 - DNA, 21 bp, Artificial Sequence
  Description of Artificial Sequence: Synthetic oligonucleotide
  modified_base (3)..(3): 2'-O-methylcytidine-5'-phosphate
  modified_base (21)..(21): 2'-deoxy-thymidine-5'-phosphate-phosphorothioate
uunauugccgauuugucggtt

SEQ ID NO: 273 - DNA, 21 bp, Artificial Sequence
  Description of Artificial Sequence: Synthetic oligonucleotide
  modified_base (4)..(4): 2'-O-methyluridine-5'-phosphate
  modified_base (5)..(5): 2'-O-methylcytidine-5'-phosphate
  modified_base (10)..(11): 2'-O-methyluridine-5'-phosphate
  modified_base (13)..(13): 2'-O-methyluridine-5'-phosphate
  modified_base (15)..(15): 2'-O-methylcytidine-5'-phosphate
  modified_base (21)..(21): 2'-deoxy-thymidine-5'-phosphate-phosphorothioate
aganngaaanngnangaagtt

SEQ ID NO: 274 - DNA, 21 bp, Artificial Sequence
  Description of Artificial Sequence: Synthetic oligonucleotide
  modified_base (6)..(6): 2'-O-methyluridine-5'-phosphate
  modified_base (8)..(8): 2'-O-methylcytidine-5'-phosphate
  modified_base (21)..(21): 2'-deoxy-thymidine-5'-phosphate-phosphorothioate
cuucgnanaauuucgaucutt

SEQ ID NO: 275 - DNA, 21 bp, Artificial Sequence
  Description of Artificial Sequence: Synthetic oligonucleotide
  modified_base (3)..(3): 2'-O-methyluridine-5'-phosphate
  modified_base (4)..(5): 2'-O-methylcytidine-5'-phosphate
  modified_base (7)..(7): 2'-O-methylcytidine-5'-phosphate
  modified_base (10)..(10): 2'-O-methylcytidine-5'-phosphate
  modified_base (11)..(11): 2'-O-methyluridine-5'-phosphate
  modified_base (13)..(13): 2'-O-methylcytidine-5'-phosphate
  modified_base (15)..(15): 2'-O-methylcytidine-5'-phosphate
  modified_base (18)..(18): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
aannngnaannangnaanntt

SEQ ID NO: 276 - DNA, 21 bp, Artificial Sequence
  Description of Artificial Sequence: Synthetic oligonucleotide
  modified_base (8)..(8): 2'-O-methyluridine-5'-phosphate
  modified_base (21)..(21): 2'-deoxy-thymidine-5'-phosphate-phosphorothioate
aguugcgnaguugcggauutt

SEQ ID NO: 277 - DNA, 21 bp, Artificial Sequence
  Description of Artificial Sequence: Synthetic oligonucleotide
  modified_base (1)..(1): 2'-O-methylcytidine-5'-phosphate
  modified_base (3)..(3): 2'-O-methylcytidine-5'-phosphate
  modified_base (5)..(6): 2'-O-methylcytidine-5'-phosphate
  modified_base (9)..(10): 2'-O-methyluridine-5'-phosphate
  modified_base (13)..(13): 2'-O-methylcytidine-5'-phosphate
  modified_base (15)..(15): 2'-O-methyluridine-5'-phosphate
  modified_base (16)..(16): 2'-O-methylcytidine-5'-phosphate
  modified_base (18)..(18): 2'-O-methyluridine-5'-phosphate
  modified_base (19)..(19): 2'-O-methylcytidine-5'-phosphate
  modified_base (21)..(21): 2'-deoxy-thymidine-5'-phosphate-phosphorothioate
nangnnaannaangnnanntt

SEQ ID NO: 278 - DNA, 21 bp, Artificial Sequence
  Description of Artificial Sequence: Synthetic oligonucleotide
  modified_base (9)..(9): 2'-O-methyluridine-5'-phosphate
  modified_base (21)..(21): 2'-deoxy-thymidine-5'-phosphate-phosphorothioate
gaugacgunaauuggcgugtt

SEQ ID NO: 279 - DNA, 21 bp, Artificial Sequence
  Description of Artificial Sequence: Synthetic oligonucleotide
  modified_base (2)..(2): 2'-O-methyluridine-5'-phosphate
  modified_base (3)..(4): 2'-O-methylcytidine-5'-phosphate
  modified_base (6)..(6): 2'-O-methylcytidine-5'-phosphate
  modified_base (9)..(9): 2'-O-methylcytidine-5'-phosphate
  modified_base (10)..(10): 2'-O-methyluridine-5'-phosphate
  modified_base (12)..(12): 2'-O-methylcytidine-5'-phosphate
  modified_base (14)..(14): 2'-O-methylcytidine-5'-phosphate
  modified_base (17)..(17): 2'-O-methylcytidine-5'-phosphate
  modified_base (18)..(18): 2'-O-methyluridine-5'-phosphate
  modified_base (21)..(21): 2'-deoxy-thymidine-5'-phosphate-phosphorothioate
annngnaannangnaanngtt

SEQ ID NO: 280 - DNA, 21 bp, Artificial Sequence
  Description of Artificial Sequence: Synthetic oligonucleotide
  modified_base (1)..(1): 2'-O-methylcytidine-5'-phosphate
  modified_base (9)..(9): 2'-O-methyluridine-5'-phosphate
  modified_base (21)..(21): 2'-deoxy-thymidine-5'-phosphate-phosphorothioate
naguugcgnaguugcggautt

SEQ ID NO: 281 - DNA, 21 bp, Artificial Sequence
  Description of Artificial Sequence: Synthetic oligonucleotide
  modified_base (1)..(2): 2'-O-methylcytidine-5'-phosphate
  modified_base (7)..(7): 2'-O-methylcytidine-5'-phosphate
  modified_base (9)..(9): 2'-O-methyluridine-5'-phosphate
  modified_base (11)..(11): 2'-O-methyluridine-5'-phosphate
  modified_base (12)..(12): 2'-O-methylcytidine-5'-phosphate
  modified_base (13)..(13): 2'-O-methyluridine-5'-phosphate
  modified_base (15)..(16): 2'-O-methylcytidine-5'-phosphate
  modified_base (18)..(19): 2'-O-methyluridine-5'-phosphate
  modified_base (21)..(21): 2'-deoxy-thymidine-5'-phosphate-phosphorothioate
nngaaananannnanngnntt

SEQ ID NO: 282 - DNA, 21 bp, Artificial Sequence
  Description of Artificial Sequence: Synthetic oligonucleotide
  modified_base (6)..(6): 2'-O-methyluridine-5'-phosphate
  modified_base (10)..(10): 2'-O-methyluridine-5'-phosphate
  modified_base (21)..(21): 2'-deoxy-thymidine-5'-phosphate-phosphorothioate
aacggnaganauguuucggtt

SEQ ID NO: 283 - DNA, 21 bp, Artificial Sequence
  Description of Artificial Sequence: Synthetic oligonucleotide
  modified_base (1)..(3): 2'-O-methyluridine-5'-phosphate
  modified_base (4)..(4): 2'-O-methylcytidine-5'-phosphate
  modified_base (5)..(5): 2'-O-methyluridine-5'-phosphate
  modified_base (7)..(8): 2'-O-methylcytidine-5'-phosphate
  modified_base (13)..(13): 2'-O-methyluridine-5'-phosphate
  modified_base (14)..(14): 2'-O-methylcytidine-5'-phosphate
  modified_base (15)..(15): 2'-O-methyluridine-5'-phosphate
  modified_base (21)..(21): 2'-deoxy-thymidine-5'-phosphate-phosphorothioate
nnnnnannggaannnaggatt

SEQ ID NO: 284 - DNA, 21 bp, Artificial Sequence
  Description of Artificial Sequence: Synthetic oligonucleotide
  modified_base (4)..(4): 2'-O-methyluridine-5'-phosphate
  modified_base (14)..(14): 2'-O-methyluridine-5'-phosphate
  modified_base (21)..(21): 2'-deoxy-thymidine-5'-phosphate-phosphorothioate
uccnagauuccggnagaaatt

SEQ ID NO: 285 - DNA, 21 bp, Artificial Sequence
  Description of Artificial Sequence: Synthetic oligonucleotide
  modified_base (2)..(3): 2'-O-methyluridine-5'-phosphate
  modified_base (6)..(6): 2'-O-methyluridine-5'-phosphate
  modified_base (7)..(7): 2'-O-methylcytidine-5'-phosphate
  modified_base (9)..(9): 2'-O-methylcytidine-5'-phosphate
  modified_base (14)..(14): 2'-O-methylcytidine-5'-phosphate
  modified_base (17)..(18): 2'-O-methyluridine-5'-phosphate
  modified_base (21)..(21): 2'-deoxy-thymidine-5'-phosphate-phosphorothioate
annaanngnggaanaanngtt

SEQ ID NO: 286 - DNA, 21 bp, Artificial Sequence
  Description of Artificial Sequence: Synthetic oligonucleotide
  modified_base (1)..(1): 2'-O-methylcytidine-5'-phosphate
  modified_base (16)..(16): 2'-O-methyluridine-5'-phosphate
  modified_base (21)..(21): 2'-deoxy-thymidine-5'-phosphate-phosphorothioate
naauuguuccgcgaunaautt

SEQ ID NO: 287 - DNA, 21 bp, Artificial Sequence
  Description of Artificial Sequence: Synthetic oligonucleotide
  modified_base (2)..(4): 2'-O-methyluridine-5'-phosphate
  modified_base (5)..(5): 2'-O-methylcytidine-5'-phosphate
  modified_base (8)..(8): 2'-O-methyluridine-5'-phosphate
  modified_base (9)..(9): 2'-O-methylcytidine-5'-phosphate
  modified_base (12)..(12): 2'-O-methyluridine-5'-phosphate
  modified_base (13)..(13): 2'-O-methylcytidine-5'-phosphate
  modified_base (18)..(18): 2'-O-methylcytidine-5'-phosphate
  modified_base (21)..(21): 2'-deoxy-thymidine-5'-phosphate-phosphorothioate
annnngannganngaganatt

SEQ ID NO: 288 - DNA, 21 bp, Artificial Sequence
  Description of Artificial Sequence: Synthetic oligonucleotide
  modified_base (1)..(1): 2'-O-methyluridine-5'-phosphate
  modified_base (21)..(21): 2'-deoxy-thymidine-5'-phosphate-phosphorothioate
ngucucgaucgaucgaaautt

SEQ ID NO: 289 - DNA, 21 bp, Artificial Sequence
  Description of Artificial Sequence: Synthetic oligonucleotide
  modified_base (5)..(5): 2'-O-methylcytidine-5'-phosphate
  modified_base (7)..(7): 2'-O-methylcytidine-5'-phosphate
  modified_base (9)..(10): 2'-O-methylcytidine-5'-phosphate
  modified_base (13)..(14): 2'-O-methyluridine-5'-phosphate
  modified_base (17)..(17): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
ggganangnnaannaangntt

SEQ ID NO: 290 - DNA, 21 bp, Artificial Sequence
  Description of Artificial Sequence: Synthetic oligonucleotide
  modified_base (5)..(5): 2'-O-methyluridine-5'-phosphate
  modified_base (21)..(21): 2'-deoxy-thymidine-5'-phosphate-phosphorothioate
acgunaauuggcguguccctt

SEQ ID NO: 291 - DNA, 21 bp, Artificial Sequence
  Description of Artificial Sequence: Synthetic oligonucleotide
  modified_base (1)..(1): 2'-O-methyluridine-5'-phosphate
  modified_base (4)..(4): 2'-O-methyluridine-5'-phosphate
  modified_base (5)..(6): 2'-O-methylcytidine-5'-phosphate
  modified_base (8)..(8): 2'-O-methylcytidine-5'-phosphate
  modified_base (11)..(11): 2'-O-methylcytidine-5'-phosphate
  modified_base (12)..(12): 2'-O-methyluridine-5'-phosphate
  modified_base (14)..(14): 2'-O-methylcytidine-5'-phosphate
  modified_base (16)..(16): 2'-O-methylcytidine-5'-phosphate
  modified_base (19)..(19): 2'-O-methylcytidine-5'-phosphate
  modified_base (21)..(21): 2'-deoxy-thymidine-5'-phosphate-phosphorothioate
naannngnaannangnaantt

SEQ ID NO: 292 - DNA, 21 bp, Artificial Sequence
  Description of Artificial Sequence: Synthetic oligonucleotide
  modified_base (7)..(7): 2'-O-methyluridine-5'-phosphate
  modified_base (18)..(18): 2'-O-methyluridine-5'-phosphate
  modified_base (21)..(21): 2'-deoxy-thymidine-5'-phosphate-phosphorothioate
guugcgnaguugcggaunatt

SEQ ID NO: 293 - DNA, 21 bp, Artificial Sequence
  Description of Artificial Sequence: Synthetic oligonucleotide
  modified_base (3)..(3): 2'-O-methyluridine-5'-phosphate
  modified_base (5)..(5): 2'-O-methylcytidine-5'-phosphate
  modified_base (6)..(6): 2'-O-methyluridine-5'-phosphate
  modified_base (10)..(10): 2'-O-methylcytidine-5'-phosphate
  modified_base (12)..(12): 2'-O-methyluridine-5'-phosphate
  modified_base (14)..(14): 2'-O-methyluridine-5'-phosphate
  modified_base (16)..(17): 2'-O-methylcytidine-5'-phosphate
  modified_base (21)..(21): 2'-deoxy-thymidine-5'-phosphate-phosphorothioate
agnannaaangngnannggtt

SEQ ID NO: 294 - DNA, 21 bp, Artificial Sequence
  Description of Artificial Sequence: Synthetic oligonucleotide
  modified_base (5)..(5): 2'-O-methyluridine-5'-phosphate
  modified_base (7)..(7): 2'-O-methylcytidine-5'-phosphate
  modified_base (13)..(13): 2'-O-methyluridine-5'-phosphate
  modified_base (16)..(16): 2'-O-methyluridine-5'-phosphate
  modified_base (21)..(21): 2'-deoxy-thymidine-5'-phosphate-phosphorothioate
ccggnanacguunagnacutt

SEQ ID NO: 295 - DNA, 21 bp, Artificial Sequence
  Description of Artificial Sequence: Synthetic oligonucleotide
  modified_base (1)..(1): 2'-O-methylcytidine-5'-phosphate
  modified_base (3)..(3): 2'-O-methylcytidine-5'-phosphate
  modified_base (5)..(5): 2'-O-methyluridine-5'-phosphate
  modified_base (6)..(6): 2'-O-methylcytidine-5'-phosphate
  modified_base (8)..(8): 2'-O-methylcytidine-5'-phosphate
  modified_base (9)..(9): 2'-O-methyluridine-5'-phosphate
  modified_base (10)..(10): 2'-O-methylcytidine-5'-phosphate
  modified_base (12)..(13): 2'-O-methyluridine-5'-phosphate
  modified_base (15)..(15): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
nananngnnnanngngaantt

SEQ ID NO: 296 - DNA, 21 bp, Artificial Sequence
  Description of Artificial Sequence: Synthetic oligonucleotide
  modified_base (6)..(6): 2'-O-methylcytidine-5'-phosphate
  modified_base (21)..(21): 2'-deoxy-thymidine-5'-phosphate-phosphorothioate
auucgnaaugagcgaugugtt

SEQ ID NO: 297 - DNA, 21 bp, Artificial Sequence
  Description of Artificial Sequence: Synthetic oligonucleotide
  modified_base (1)..(1): 2'-O-methylcytidine-5'-phosphate
  modified_base (3)..(3): 2'-O-methyluridine-5'-phosphate
  modified_base (4)..(4): 2'-O-methylcytidine-5'-phosphate
  modified_base (6)..(6): 2'-O-methylcytidine-5'-phosphate
  modified_base (7)..(7): 2'-O-methyluridine-5'-phosphate
  modified_base (8)..(8): 2'-O-methylcytidine-5'-phosphate
  modified_base (10)..(11): 2'-O-methyluridine-5'-phosphate
  modified_base (13)..(13): 2'-O-methylcytidine-5'-phosphate
  modified_base (17)..(17): 2'-O-methyluridine-5'-phosphate
  modified_base (19)..(19): 2'-O-methylcytidine-5'-phosphate
  modified_base (21)..(21): 2'-deoxy-thymidine-5'-phosphate-phosphorothioate
nanngnnnanngngaanantt

SEQ ID NO: 298 - DNA, 21 bp, Artificial Sequence
  Description of Artificial Sequence: Synthetic oligonucleotide
  modified_base (2)..(2): 2'-O-methyluridine-5'-phosphate
  modified_base (8)..(8): 2'-O-methylcytidine-5'-phosphate
  modified_base (21)..(21): 2'-deoxy-thymidine-5'-phosphate-phosphorothioate
gnauucgnaaugagcgaugtt

SEQ ID NO: 299 - DNA, 21 bp, Artificial Sequence
  Description of Artificial Sequence: Synthetic oligonucleotide
  modified_base (2)..(2): 2'-O-methylcytidine-5'-phosphate
  modified_base (6)..(6): 2'-O-methyluridine-5'-phosphate
  modified_base (7)..(7): 2'-O-methylcytidine-5'-phosphate
  modified_base (12)..(13): 2'-O-methyluridine-5'-phosphate
  modified_base (15)..(15): 2'-O-methyluridine-5'-phosphate
  modified_base (17)..(17): 2'-O-methylcytidine-5'-phosphate
  modified_base (21)..(21): 2'-deoxy-thymidine-5'-phosphate-phosphorothioate
anaganngaaanngnangatt

SEQ ID NO: 300 - DNA, 21 bp, Artificial Sequence
  Description of Artificial Sequence: Synthetic oligonucleotide
  modified_base (4)..(4): 2'-O-methyluridine-5'-phosphate
  modified_base (6)..(6): 2'-O-methylcytidine-5'-phosphate
  modified_base (21)..(21): 2'-deoxy-thymidine-5'-phosphate-phosphorothioate
ucgnanaauuucgaucugutt

SEQ ID NO: 301 - DNA, 21 bp, Artificial Sequence
  Description of Artificial Sequence: Synthetic oligonucleotide
  modified_base (3)..(3): 2'-O-methylcytidine-5'-phosphate
  modified_base (4)..(5): 2'-O-methyluridine-5'-phosphate
  modified_base (7)..(7): 2'-O-methylcytidine-5'-phosphate
  modified_base (11)..(12): 2'-O-methyluridine-5'-phosphate
  modified_base (14)..(14): 2'-O-methyluridine-5'-phosphate
  modified_base (16)..(17): 2'-O-methyluridine-5'-phosphate
  modified_base (18)..(18): 2'-O-methylcytidine-5'-phosphate
  modified_base (21)..(21): 2'-deoxy-thymidine-5'-phosphate-phosphorothioate
agnnngngggnnanannnatt

SEQ ID NO: 302 - DNA, 21 bp, Artificial Sequence
  Description of Artificial Sequence: Synthetic oligonucleotide
  modified_base (5)..(5): 2'-O-methyluridine-5'-phosphate
  modified_base (7)..(7): 2'-O-methyluridine-5'-phosphate
  modified_base (14)..(14): 2'-O-methylcytidine-5'-phosphate
  modified_base (21)..(21): 2'-deoxy-thymidine-5'-phosphate-phosphorothioate
ugaananaacccgnaagcutt

SEQ ID NO: 303 - DNA, 21 bp, Artificial Sequence
  Description of Artificial Sequence: Synthetic oligonucleotide
  modified_base (1)..(1): 2'-O-methylcytidine-5'-phosphate
  modified_base (2)..(2): 2'-O-methyluridine-5'-phosphate
  modified_base (4)..(5): 2'-O-methylcytidine-5'-phosphate
  modified_base (8)..(8): 2'-O-methylcytidine-5'-phosphate
  modified_base (10)..(10): 2'-O-methyluridine-5'-phosphate
  modified_base (11)..(11): 2'-O-methylcytidine-5'-phosphate
  modified_base (12)..(13): 2'-O-methyluridine-5'-phosphate
  modified_base (16)..(16): 2'-O-methyluridine-5'-phosphate
  modified_base (19)..(19): 2'-O-methyluridine-5'-phosphate
  modified_base (21)..(21): 2'-deoxy-thymidine-5'-phosphate-phosphorothioate
nngnngangnnnnganaantt

SEQ ID NO: 304 - DNA, 21 bp, Artificial Sequence
  Description of Artificial Sequence: Synthetic oligonucleotide
  modified_base (3)..(3): 2'-O-methyluridine-5'-phosphate
  modified_base (6)..(6): 2'-O-methylcytidine-5'-phosphate
  modified_base (17)..(17): 2'-O-methylcytidine-5'-phosphate
  modified_base (21)..(21): 2'-deoxy-thymidine-5'-phosphate-phosphorothioate
aunaunaagacgucggnagtt

SEQ ID NO: 305 - DNA, 21 bp, Artificial Sequence
  Description of Artificial Sequence: Synthetic oligonucleotide
  modified_base (3)..(3): 2'-O-methyluridine-5'-phosphate
  modified_base (5)..(5): 2'-O-methylcytidine-5'-phosphate
  modified_base (6)..(7): 2'-O-methyluridine-5'-phosphate
  modified_base (9)..(9): 2'-O-methylcytidine-5'-phosphate
  modified_base (12)..(12): 2'-O-methylcytidine-5'-phosphate
  modified_base (15)..(16): 2'-O-methyluridine-5'-phosphate
  modified_base (21)..(21): 2'-deoxy-thymidine-5'-phosphate-phosphorothioate
agnannnanggnaanngagtt

SEQ ID NO: 306 - DNA, 21 bp, Artificial Sequence
  Description of Artificial Sequence: Synthetic oligonucleotide
  modified_base (3)..(3): 2'-O-methylcytidine-5'-phosphate
  modified_base (12)..(12): 2'-O-methyluridine-5'-phosphate
  modified_base (16)..(16): 2'-O-methyluridine-5'-phosphate
  modified_base (21)..(21): 2'-deoxy-thymidine-5'-phosphate-phosphorothioate
cunaauugccgnaagnacutt

SEQ ID NO: 307 - DNA, 21 bp, Artificial Sequence
  Description of Artificial Sequence: Synthetic oligonucleotide
  modified_base (3)..(4): 2'-O-methylcytidine-5'-phosphate
  modified_base (5)..(5): 2'-O-methyluridine-5'-phosphate
  modified_base (6)..(6): 2'-O-methylcytidine-5'-phosphate
  modified_base (8)..(8): 2'-O-methyluridine-5'-phosphate
  modified_base (9)..(9): 2'-O-methylcytidine-5'-phosphate
  modified_base (12)..(13): 2'-O-methyluridine-5'-phosphate
  modified_base (14)..(14): 2'-O-methylcytidine-5'-phosphate
  modified_base (21)..(21): 2'-deoxy-thymidine-5'-phosphate-phosphorothioate
aannnngnngannnaaaaatt

SEQ ID NO: 308 - DNA, 21 bp, Artificial Sequence
  Description of Artificial Sequence: Synthetic oligonucleotide
  modified_base (1)..(5): 2'-O-methyluridine-5'-phosphate
  modified_base (18)..(18): 2'-O-methyluridine-5'-phosphate
  modified_base (21)..(21): 2'-deoxy-thymidine-5'-phosphate-phosphorothioate
nnnnngaaucgacgaggnutt

SEQ ID NO: 309 - DNA, 21 bp, Artificial Sequence
  Description of Artificial Sequence: Synthetic oligonucleotide
  modified_base (3)..(3): 2'-O-methylcytidine-5'-phosphate
  modified_base (4)..(4): 2'-O-methyluridine-5'-phosphate
  modified_base (8)..(10): 2'-O-methyluridine-5'-phosphate
  modified_base (11)..(11): 2'-O-methylcytidine-5'-phosphate
  modified_base (14)..(14): 2'-O-methyluridine-5'-phosphate
  modified_base (15)..(15): 2'-O-methylcytidine-5'-phosphate
  modified_base (18)..(18): 2'-O-methyluridine-5'-phosphate
  modified_base (19)..(19): 2'-O-methylcytidine-5'-phosphate
  modified_base (21)..(21): 2'-deoxy-thymidine-5'-phosphate-phosphorothioate
aannaaannnngannganntt

SEQ ID NO: 310 - DNA, 21 bp, Artificial Sequence
  Description of Artificial Sequence: Synthetic oligonucleotide
  modified_base (15)..(15): 2'-O-methyluridine-5'-phosphate
  modified_base (21)..(21): 2'-deoxy-thymidine-5'-phosphate-phosphorothioate
gaucgaucgaaauunaguutt

SEQ ID NO: 311 - DNA, 21 bp, Artificial Sequence
  Description of Artificial Sequence: Synthetic oligonucleotide
  modified_base (2)..(3): 2'-O-methylcytidine-5'-phosphate
  modified_base (4)..(5): 2'-O-methyluridine-5'-phosphate
  modified_base (7)..(7): 2'-O-methyluridine-5'-phosphate
  modified_base (8)..(9): 2'-O-methylcytidine-5'-phosphate
  modified_base (12)..(12): 2'-O-methylcytidine-5'-phosphate
  modified_base (13)..(13): 2'-O-methyluridine-5'-phosphate
  modified_base (14)..(14): 2'-O-methylcytidine-5'-phosphate
  modified_base (16)..(16): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
gnnnnannngannngnaantt

SEQ ID NO: 312 - DNA, 21 bp, Artificial Sequence
  Description of Artificial Sequence: Synthetic oligonucleotide
  modified_base (14)..(14): 2'-O-methyluridine-5'-phosphate
  modified_base (21)..(21): 2'-deoxy-thymidine-5'-phosphate-phosphorothioate
auugcgagucgganaaggctt

SEQ ID NO: 313 - DNA, 21 bp, Artificial Sequence
  Description of Artificial Sequence: Synthetic oligonucleotide
  modified_base (1)..(1): 2'-O-methylcytidine-5'-phosphate
  modified_base (2)..(3): 2'-O-methyluridine-5'-phosphate
  modified_base (5)..(5): 2'-O-methyluridine-5'-phosphate
  modified_base (6)..(7): 2'-O-methylcytidine-5'-phosphate
  modified_base (10)..(10): 2'-O-methylcytidine-5'-phosphate
  modified_base (11)..(11): 2'-O-methyluridine-5'-phosphate
  modified_base (12)..(12): 2'-O-methylcytidine-5'-phosphate
  modified_base (14)..(14): 2'-O-methylcytidine-5'-phosphate
  modified_base (17)..(17): 2'-O-methyluridine-5'-phosphate
  modified_base (19)..(19): 2'-O-methyluridine-5'-phosphate
  modified_base (21)..(21): 2'-deoxy-thymidine-5'-phosphate-phosphorothioate
nnnannngannngnaangntt

SEQ ID NO: 314 - DNA, 21 bp, Artificial Sequence
  Description of Artificial Sequence: Synthetic oligonucleotide
  modified_base (2)..(2): 2'-O-methylcytidine-5'-phosphate
  modified_base (16)..(16): 2'-O-methyluridine-5'-phosphate
  modified_base (21)..(21): 2'-deoxy-thymidine-5'-phosphate-phosphorothioate
anauugcgagucgganaagtt

SEQ ID NO: 315 - DNA, 21 bp, Artificial Sequence
  Description of Artificial Sequence: Synthetic oligonucleotide
  modified_base (2)..(2): 2'-O-methyluridine-5'-phosphate
  modified_base (3)..(3): 2'-O-methylcytidine-5'-phosphate
  modified_base (5)..(8): 2'-O-methyluridine-5'-phosphate
  modified_base (10)..(10): 2'-O-methylcytidine-5'-phosphate
  modified_base (13)..(14): 2'-O-methylcytidine-5'-phosphate
  modified_base (17)..(17): 2'-O-methyluridine-5'-phosphate
  modified_base (19)..(19): 2'-O-methyluridine-5'-phosphate
  modified_base (21)..(21): 2'-deoxy-thymidine-5'-phosphate-phosphorothioate
gnngnnnngnggnnganantt

SEQ ID NO: 316 - DNA, 21 bp, Artificial Sequence
  Description of Artificial Sequence: Synthetic oligonucleotide
  modified_base (2)..(2): 2'-O-methyluridine-5'-phosphate
  modified_base (11)..(11): 2'-O-methylcytidine-5'-phosphate
  modified_base (21)..(21): 2'-deoxy-thymidine-5'-phosphate-phosphorothioate
anaucggccgnaaaacgactt

SEQ ID NO: 317 - DNA, 21 bp, Artificial Sequence
  Description of Artificial Sequence: Synthetic oligonucleotide
  modified_base (1)..(1): 2'-O-methyluridine-5'-phosphate
  modified_base (2)..(2): 2'-O-methylcytidine-5'-phosphate
  modified_base (4)..(7): 2'-O-methyluridine-5'-phosphate
  modified_base (9)..(9): 2'-O-methylcytidine-5'-phosphate
  modified_base (12)..(13): 2'-O-methylcytidine-5'-phosphate
  modified_base (16)..(16): 2'-O-methyluridine-5'-phosphate
  modified_base (18)..(18): 2'-O-methyluridine-5'-phosphate
  modified_base (19)..(19): 2'-O-methylcytidine-5'-phosphate
  modified_base (21)..(21): 2'-deoxy-thymidine-5'-phosphate-phosphorothioate
nngnnnngnggnngananntt

SEQ ID NO: 318 - DNA, 21 bp, Artificial Sequence
  Description of Artificial Sequence: Synthetic oligonucleotide
  modified_base (3)..(3): 2'-O-methyluridine-5'-phosphate
  modified_base (12)..(12): 2'-O-methylcytidine-5'-phosphate
  modified_base (21)..(21): 2'-deoxy-thymidine-5'-phosphate-phosphorothioate
ganaucggccgnaaaacgatt

SEQ ID NO: 319 - DNA, 21 bp, Artificial Sequence
  Description of Artificial Sequence: Synthetic oligonucleotide
  modified_base (4)..(6): 2'-O-methyluridine-5'-phosphate
  modified_base (7)..(7): 2'-O-methylcytidine-5'-phosphate
  modified_base (10)..(10): 2'-O-methyluridine-5'-phosphate
  modified_base (11)..(11): 2'-O-methylcytidine-5'-phosphate
  modified_base (14)..(14): 2'-O-methyluridine-5'-phosphate
  modified_base (15)..(15): 2'-O-methylcytidine-5'-phosphate
  modified_base (21)..(21): 2'-deoxy-thymidine-5'-phosphate-phosphorothioate
aaannnngannganngagatt

SEQ ID NO: 320 - DNA, 21 bp, Artificial Sequence
  Description of Artificial Sequence: Synthetic oligonucleotide
  modified_base (17)..(18): 2'-O-methyluridine-5'-phosphate
  modified_base (21)..(21): 2'-deoxy-thymidine-5'-phosphate-phosphorothioate
ucucgaucgaucgaaannutt

SEQ ID NO: 321 - DNA, 21 bp, Artificial Sequence
  Description of Artificial Sequence: Synthetic oligonucleotide
  modified_base (2)..(2): 2'-O-methyluridine-5'-phosphate
  modified_base (5)..(6): 2'-O-methylcytidine-5'-phosphate
  modified_base (7)..(7): 2'-O-methyluridine-5'-phosphate
  modified_base (8)..(8): 2'-O-methylcytidine-5'-phosphate
  modified_base (10)..(10): 2'-O-methyluridine-5'-phosphate
  modified_base (11)..(11): 2'-O-methylcytidine-5'-phosphate
  modified_base (14)..(15): 2'-O-methyluridine-5'-phosphate
  modified_base (16)..(16): 2'-O-methylcytidine-5'-phosphate
  modified_base (21)..(21): 2'-deoxy-thymidine-5'-phosphate-phosphorothioate
anaannnngnngannnaaatt

SEQ ID NO: 322 - DNA, 21 bp, Artificial Sequence
  Description of Artificial Sequence: Synthetic oligonucleotide
  modified_base (17)..(17): 2'-O-methyluridine-5'-phosphate
  modified_base (21)..(21): 2'-deoxy-thymidine-5'-phosphate-phosphorothioate
uuugaaucgacgaggunautt

SEQ ID NO: 323 - DNA, 21 bp, Artificial Sequence
  Description of Artificial Sequence: Synthetic oligonucleotide
  modified_base (1)..(1): 2'-O-methyluridine-5'-phosphate
  modified_base (3)..(3): 2'-O-methylcytidine-5'-phosphate
  modified_base (4)..(4): 2'-O-methyluridine-5'-phosphate
  modified_base (6)..(7): 2'-O-methylcytidine-5'-phosphate
  modified_base (9)..(9): 2'-O-methylcytidine-5'-phosphate
  modified_base (12)..(12): 2'-O-methyluridine-5'-phosphate
  modified_base (14)..(14): 2'-O-methyluridine-5'-phosphate
  modified_base (15)..(15): 2'-O-methylcytidine-5'-phosphate
  modified_base (21)..(21): 2'-deoxy-thymidine-5'-phosphate-phosphorothioate
nannannanaanannggaatt

SEQ ID NO: 324 - DNA, 21 bp, Artificial Sequence
  Description of Artificial Sequence: Synthetic oligonucleotide
  modified_base (7)..(7): 2'-O-methyluridine-5'-phosphate
  modified_base (15)..(15): 2'-O-methyluridine-5'-phosphate
  modified_base (18)..(18): 2'-O-methyluridine-5'-phosphate
  modified_base (21)..(21): 2'-deoxy-thymidine-5'-phosphate-phosphorothioate
uuccganauuguggnagnatt

SEQ ID NO: 325 - DNA, 21 bp, Artificial Sequence
  Description of Artificial Sequence: Synthetic oligonucleotide
  modified_base (1)..(2): 2'-O-methyluridine-5'-phosphate
  modified_base (4)..(4): 2'-O-methyluridine-5'-phosphate
  modified_base (5)..(6): 2'-O-methylcytidine-5'-phosphate
  modified_base (9)..(9): 2'-O-methylcytidine-5'-phosphate
  modified_base (10)..(10): 2'-O-methyluridine-5'-phosphate
  modified_base (11)..(11): 2'-O-methylcytidine-5'-phosphate
  modified_base (13)..(13): 2'-O-methylcytidine-5'-phosphate
  modified_base (16)..(16): 2'-O-methyluridine-5'-phosphate
  modified_base (18)..(19): 2'-O-methyluridine-5'-phosphate
  modified_base (21)..(21): 2'-deoxy-thymidine-5'-phosphate-phosphorothioate
nnannngannngnaangnntt

SEQ ID NO: 326 - DNA, 21 bp, Artificial Sequence
  Description of Artificial Sequence: Synthetic oligonucleotide
  modified_base (3)..(3): 2'-O-methylcytidine-5'-phosphate
  modified_base (17)..(17): 2'-O-methyluridine-5'-phosphate
  modified_base (21)..(21): 2'-deoxy-thymidine-5'-phosphate-phosphorothioate
aanauugcgagucgganaatt

SEQ ID NO: 327 - DNA, 21 bp, Artificial Sequence
  Description of Artificial Sequence: Synthetic oligonucleotide
  modified_base (2)..(2): 2'-O-methylcytidine-5'-phosphate
  modified_base (3)..(3): 2'-O-methyluridine-5'-phosphate
  modified_base (7)..(9): 2'-O-methyluridine-5'-phosphate
  modified_base (10)..(10): 2'-O-methylcytidine-5'-phosphate
  modified_base (13)..(13): 2'-O-methyluridine-5'-phosphate
  modified_base (14)..(14): 2'-O-methylcytidine-5'-phosphate
  modified_base (17)..(17): 2'-O-methyluridine-5'-phosphate
  modified_base (18)..(18): 2'-O-methylcytidine-5'-phosphate
  modified_base (21)..(21): 2'-deoxy-thymidine-5'-phosphate-phosphorothioate
annaaannnngannganngtt

SEQ ID NO: 328 - DNA, 21 bp, Artificial Sequence
  Description of Artificial Sequence: Synthetic oligonucleotide
  modified_base (16)..(16): 2'-O-methyluridine-5'-phosphate
  modified_base (21)..(21): 2'-deoxy-thymidine-5'-phosphate-phosphorothioate
cgaucgaucgaaauunagutt

SEQ ID NO: 329 - DNA, 21 bp, Artificial Sequence
  Description of Artificial Sequence: Synthetic oligonucleotide
  modified_base (1)..(3): 2'-O-methyluridine-5'-phosphate
  modified_base (4)..(4): 2'-O-methylcytidine-5'-phosphate
  modified_base (7)..(7): 2'-O-methyluridine-5'-phosphate
  modified_base (8)..(8): 2'-O-methylcytidine-5'-phosphate
  modified_base (11)..(11): 2'-O-methyluridine-5'-phosphate
  modified_base (12)..(12): 2'-O-methylcytidine-5'-phosphate
  modified_base (17)..(17): 2'-O-methylcytidine-5'-phosphate
  modified_base (19)..(19): 2'-O-methylcytidine-5'-phosphate
  modified_base (21)..(21): 2'-deoxy-thymidine-5'-phosphate-phosphorothioate
nnnngannganngaganantt

SEQ ID NO: 330 - DNA, 21 bp, Artificial Sequence
  Description of Artificial Sequence: Synthetic oligonucleotide
  modified_base (2)..(2): 2'-O-methyluridine-5'-phosphate
  modified_base (21)..(21): 2'-deoxy-thymidine-5'-phosphate-phosphorothioate
gngucucgaucgaucgaaatt

SEQ ID NO: 331 - DNA, 21 bp, Artificial Sequence
  Description of Artificial Sequence: Synthetic oligonucleotide
  modified_base (2)..(2): 2'-O-methylcytidine-5'-phosphate
  modified_base (4)..(4): 2'-O-methylcytidine-5'-phosphate
  modified_base (6)..(7): 2'-O-methylcytidine-5'-phosphate
  modified_base (10)..(11): 2'-O-methyluridine-5'-phosphate
  modified_base (14)..(14): 2'-O-methylcytidine-5'-phosphate
  modified_base (16)..(16): 2'-O-methyluridine-5'-phosphate
  modified_base (17)..(17): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
anangnnaannaangnnantt

SEQ ID NO: 332 - DNA, 21 bp, Artificial Sequence
  Description of Artificial Sequence: Synthetic oligonucleotide
  modified_base (8)..(8): 2'-O-methyluridine-5'-phosphate
  modified_base (21)..(21): 2'-deoxy-thymidine-5'-phosphate-phosphorothioate
augacgunaauuggcgugutt

SEQ ID NO: 333 - DNA, 21 bp, Artificial Sequence
  Description of Artificial Sequence: Synthetic oligonucleotide
  modified_base (4)..(5): 2'-O-methyluridine-5'-phosphate
  modified_base (7)..(7): 2'-O-methyluridine-5'-phosphate
  modified_base (9)..(9): 2'-O-methyluridine-5'-phosphate
  modified_base (10)..(11): 2'-O-methylcytidine-5'-phosphate
  modified_base (13)..(14): 2'-O-methylcytidine-5'-phosphate
  modified_base (15)..(16): 2'-O-methyluridine-5'-phosphate
  modified_base (19)..(19): 2'-O-methyluridine-5'-phosphate
  modified_base (21)..(21): 2'-deoxy-thymidine-5'-phosphate-phosphorothioate
aagnnanannngnnnnggntt

SEQ ID NO: 334 - DNA, 21 bp, Artificial Sequence
  Description of Artificial Sequence: Synthetic oligonucleotide
  modified_base (3)..(3): 2'-O-methylcytidine-5'-phosphate
  modified_base (12)..(12): 2'-O-methyluridine-5'-phosphate
  modified_base (14)..(14): 2'-O-methyluridine-5'-phosphate
  modified_base (21)..(21): 2'-deoxy-thymidine-5'-phosphate-phosphorothioate
acnaaggcggananaacuutt

SEQ ID NO: 335 - DNA, 21 bp, Artificial Sequence
  Description of Artificial Sequence: Synthetic oligonucleotide
  modified_base (2)..(2): 2'-O-methyluridine-5'-phosphate
  modified_base (4)..(4): 2'-O-methylcytidine-5'-phosphate
  modified_base (5)..(5): 2'-O-methyluridine-5'-phosphate
  modified_base (6)..(8): 2'-O-methylcytidine-5'-phosphate
  modified_base (9)..(10): 2'-O-methyluridine-5'-phosphate
  modified_base (13)..(13): 2'-O-methyluridine-5'-phosphate
  modified_base (14)..(15): 2'-O-methylcytidine-5'-phosphate
  modified_base (17)..(17): 2'-O-methylcytidine-5'-phosphate
  modified_base (21)..(21): 2'-deoxy-thymidine-5'-phosphate-phosphorothioate
anannnnnnnaannngnaatt

SEQ ID NO: 336 - DNA, 21 bp, Artificial Sequence
  Description of Artificial Sequence: Synthetic oligonucleotide
  modified_base (9)..(9): 2'-O-methyluridine-5'-phosphate
  modified_base (17)..(17): 2'-O-methyluridine-5'-phosphate
  modified_base (21)..(21): 2'-deoxy-thymidine-5'-phosphate-phosphorothioate
uugcggaunaagggagnautt

SEQ ID NO: 337 - DNA, 21 bp, Artificial Sequence
  Description of Artificial Sequence: Synthetic oligonucleotide
  modified_base (1)..(1): 2'-O-methyluridine-5'-phosphate
  modified_base (2)..(3): 2'-O-methylcytidine-5'-phosphate
  modified_base (5)..(5): 2'-O-methylcytidine-5'-phosphate
  modified_base (8)..(8): 2'-O-methylcytidine-5'-phosphate
  modified_base (9)..(9): 2'-O-methyluridine-5'-phosphate
  modified_base (11)..(11): 2'-O-methylcytidine-5'-phosphate
  modified_base (13)..(13): 2'-O-methylcytidine-5'-phosphate
  modified_base (16)..(16): 2'-O-methylcytidine-5'-phosphate
  modified_base (17)..(17): 2'-O-methyluridine-5'-phosphate
  modified_base (19)..(19): 2'-O-methyluridine-5'-phosphate
  modified_base (21)..(21): 2'-deoxy-thymidine-5'-phosphate-phosphorothioate
nnngnaannangnaanngntt

SEQ ID NO: 338 - DNA, 21 bp, Artificial Sequence
  Description of Artificial Sequence: Synthetic oligonucleotide
  modified_base (2)..(2): 2'-O-methylcytidine-5'-phosphate
  modified_base (10)..(10): 2'-O-methyluridine-5'-phosphate
  modified_base (21)..(21): 2'-deoxy-thymidine-5'-phosphate-phosphorothioate
anaguugcgnaguugcggatt

SEQ ID NO: 339 - DNA, 21 bp, Artificial Sequence
  Description of Artificial Sequence: Synthetic oligonucleotide
  modified_base (1)..(1): 2'-O-methyluridine-5'-phosphate
  modified_base (2)..(2): 2'-O-methylcytidine-5'-phosphate
  modified_base (10)..(10): 2'-O-methylcytidine-5'-phosphate
  modified_base (11)..(11): 2'-O-methyluridine-5'-phosphate
  modified_base (12)..(12): 2'-O-methylcytidine-5'-phosphate
  modified_base (13)..(13): 2'-O-methyluridine-5'-phosphate
  modified_base (17)..(17): 2'-O-methyluridine-5'-phosphate
  modified_base (18)..(18): 2'-O-methylcytidine-5'-phosphate
  modified_base (21)..(21): 2'-deoxy-thymidine-5'-phosphate-phosphorothioate
nngaggaaannnnagannatt

SEQ ID NO: 340 - DNA, 21 bp, Artificial Sequence
  Description of Artificial Sequence: Synthetic oligonucleotide
  modified_base (6)..(6): 2'-O-methyluridine-5'-phosphate
  modified_base (21)..(21): 2'-deoxy-thymidine-5'-phosphate-phosphorothioate
ugaucnagaguuuccucgatt

SEQ ID NO: 341 - DNA, 21 bp, Artificial Sequence
  Description of Artificial Sequence: Synthetic oligonucleotide
  modified_base (1)..(1): 2'-O-methyluridine-5'-phosphate
  modified_base (3)..(3): 2'-O-methylcytidine-5'-phosphate
  modified_base (6)..(6): 2'-O-methyluridine-5'-phosphate
  modified_base (8)..(9): 2'-O-methyluridine-5'-phosphate
  modified_base (10)..(10): 2'-O-methylcytidine-5'-phosphate
  modified_base (14)..(15): 2'-O-methylcytidine-5'-phosphate
  modified_base (16)..(16): 2'-O-methyluridine-5'-phosphate
  modified_base (19)..(19): 2'-O-methyluridine-5'-phosphate
  modified_base (21)..(21): 2'-deoxy-thymidine-5'-phosphate-phosphorothioate
ngnagnannngagnnnaantt

SEQ ID NO: 342 - DNA, 21 bp, Artificial Sequence
  Description of Artificial Sequence: Synthetic oligonucleotide
  modified_base (3)..(3): 2'-O-methyluridine-5'-phosphate
  modified_base (13)..(13): 2'-O-methyluridine-5'-phosphate
  modified_base (18)..(18): 2'-O-methylcytidine-5'-phosphate
  modified_base (21)..(21): 2'-deoxy-thymidine-5'-phosphate-phosphorothioate
aunaggcucgaanacugnatt

SEQ ID NO: 343 - DNA, 21 bp, Artificial Sequence
  Description of Artificial Sequence: Synthetic oligonucleotide
  modified_base (2)..(2): 2'-O-methylcytidine-5'-phosphate
  modified_base (5)..(5): 2'-O-methyluridine-5'-phosphate
  modified_base (7)..(8): 2'-O-methyluridine-5'-phosphate
  modified_base (9)..(9): 2'-O-methylcytidine-5'-phosphate
  modified_base (13)..(14): 2'-O-methylcytidine-5'-phosphate
  modified_base (15)..(15): 2'-O-methyluridine-5'-phosphate
  modified_base (18)..(18): 2'-O-methyluridine-5'-phosphate
  modified_base (21)..(21): 2'-deoxy-thymidine-5'-phosphate-phosphorothioate
gnagnannngagnnnaangtt

SEQ ID NO: 344 - DNA, 21 bp, Artificial Sequence
  Description of Artificial Sequence: Synthetic oligonucleotide
  modified_base (1)..(1): 2'-O-methylcytidine-5'-phosphate
  modified_base (4)..(4): 2'-O-methyluridine-5'-phosphate
  modified_base (14)..(14): 2'-O-methyluridine-5'-phosphate
  modified_base (21)..(21): 2'-deoxy-thymidine-5'-phosphate-phosphorothioate
naunaggcucgaanacugctt

SEQ ID NO: 345 - DNA, 21 bp, Artificial Sequence
  Description of Artificial Sequence: Synthetic oligonucleotide
  modified_base (1)..(1): 2'-O-methylcytidine-5'-phosphate
  modified_base (4)..(4): 2'-O-methyluridine-5'-phosphate
  modified_base (6)..(7): 2'-O-methyluridine-5'-phosphate
  modified_base (8)..(8): 2'-O-methylcytidine-5'-phosphate
  modified_base (12)..(13): 2'-O-methylcytidine-5'-phosphate
  modified_base (14)..(14): 2'-O-methyluridine-5'-phosphate
  modified_base (17)..(17): 2'-O-methyluridine-5'-phosphate
  modified_base (19)..(19): 2'-O-methyluridine-5'-phosphate
  modified_base (21)..(21): 2'-deoxy-thymidine-5'-phosphate-phosphorothioate
nagnannngagnnnaangntt

SEQ ID NO: 346 - DNA, 21 bp, Artificial Sequence
  Description of Artificial Sequence: Synthetic oligonucleotide
  modified_base (2)..(2): 2'-O-methylcytidine-5'-phosphate
  modified_base (5)..(5): 2'-O-methyluridine-5'-phosphate
  modified_base (15)..(15): 2'-O-methyluridine-5'-phosphate
  modified_base (21)..(21): 2'-deoxy-thymidine-5'-phosphate-phosphorothioate
anaunaggcucgaanacugtt

SEQ ID NO: 347 - DNA, 21 bp, Artificial Sequence
  Description of Artificial Sequence: Synthetic oligonucleotide
  modified_base (1)..(1): 2'-O-methylcytidine-5'-phosphate
  modified_base (3)..(4): 2'-O-methyluridine-5'-phosphate
  modified_base (7)..(7): 2'-O-methylcytidine-5'-phosphate
  modified_base (9)..(9): 2'-O-methylcytidine-5'-phosphate
  modified_base (10)..(10): 2'-O-methyluridine-5'-phosphate
  modified_base (13)..(13): 2'-O-methylcytidine-5'-phosphate
  modified_base (16)..(16): 2'-O-methyluridine-5'-phosphate
  modified_base (18)..(19): 2'-O-methylcytidine-5'-phosphate
  modified_base (21)..(21): 2'-deoxy-thymidine-5'-phosphate-phosphorothioate
nannggnannagnggnanntt

SEQ ID NO: 348 - DNA, 21 bp, Artificial Sequence
  Description of Artificial Sequence: Synthetic oligonucleotide
  modified_base (3)..(3): 2'-O-methyluridine-5'-phosphate
  modified_base (9)..(9): 2'-O-methyluridine-5'-phosphate
  modified_base (15)..(15): 2'-O-methylcytidine-5'-phosphate
  modified_base (21)..(21): 2'-deoxy-thymidine-5'-phosphate-phosphorothioate
ggnaccgcnagugcnaaugtt

SEQ ID NO: 349 - DNA, 21 bp, Artificial Sequence
  Description of Artificial Sequence: Synthetic oligonucleotide
  modified_base (1)..(1): 2'-O-methyluridine-5'-phosphate
  modified_base (3)..(5): 2'-O-methyluridine-5'-phosphate
  modified_base (6)..(6): 2'-O-methylcytidine-5'-phosphate
  modified_base (7)..(7): 2'-O-methyluridine-5'-phosphate
  modified_base (9)..(10): 2'-O-methylcytidine-5'-phosphate
  modified_base (15)..(15): 2'-O-methyluridine-5'-phosphate
  modified_base (16)..(16): 2'-O-methylcytidine-5'-phosphate
  modified_base (17)..(17): 2'-O-methyluridine-5'-phosphate
  modified_base (21)..(21): 2'-deoxy-thymidine-5'-phosphate-phosphorothioate
ngnnnnnannggaannnagtt

SEQ ID NO: 350 - DNA, 21 bp, Artificial Sequence
  Description of Artificial Sequence: Synthetic oligonucleotide
  modified_base (2)..(2): 2'-O-methyluridine-5'-phosphate
  modified_base (12)..(12): 2'-O-methyluridine-5'-phosphate
  modified_base (18)..(18): 2'-O-methylcytidine-5'-phosphate
  modified_base (21)..(21): 2'-deoxy-thymidine-5'-phosphate-phosphorothioate
cnagauuccggnagaaanatt

SEQ ID NO: 351 - DNA, 21 bp, Artificial Sequence
  Description of Artificial Sequence: Synthetic oligonucleotide
  modified_base (2)..(2): 2'-O-methylcytidine-5'-phosphate
  modified_base (3)..(4): 2'-O-methyluridine-5'-phosphate
  modified_base (6)..(6): 2'-O-methyluridine-5'-phosphate
  modified_base (7)..(7): 2'-O-methylcytidine-5'-phosphate
  modified_base (8)..(8): 2'-O-methyluridine-5'-phosphate
  modified_base (9)..(10): 2'-O-methylcytidine-5'-phosphate
  modified_base (14)..(14): 2'-O-methyluridine-5'-phosphate
  modified_base (17)..(18): 2'-O-methyluridine-5'-phosphate
  modified_base (21)..(21): 2'-deoxy-thymidine-5'-phosphate-phosphorothioate
annnannnnngaanganngtt

SEQ ID NO: 352 - DNA, 21 bp, Artificial Sequence
  Description of Artificial Sequence: Synthetic oligonucleotide
  modified_base (1)..(1): 2'-O-methylcytidine-5'-phosphate
  modified_base (5)..(5): 2'-O-methylcytidine-5'-phosphate
  modified_base (15)..(15): 2'-O-methyluridine-5'-phosphate
  modified_base (21)..(21): 2'-deoxy-thymidine-5'-phosphate-phosphorothioate
naaunauucggaganaagutt

SEQ ID NO: 353 - DNA, 21 bp, Artificial Sequence
  Description of Artificial Sequence: Synthetic oligonucleotide
  modified_base (4)..(4): 2'-O-methyluridine-5'-phosphate
  modified_base (5)..(6): 2'-O-methylcytidine-5'-phosphate
  modified_base (7)..(7): 2'-O-methyluridine-5'-phosphate
  modified_base (10)..(10): 2'-O-methylcytidine-5'-phosphate
  modified_base (14)..(15): 2'-O-methyluridine-5'-phosphate
  modified_base (19)..(19): 2'-O-methyluridine-5'-phosphate
  modified_base (21)..(21): 2'-deoxy-thymidine-5'-phosphate-phosphorothioate
aaannnnagnggannaaantt

SEQ ID NO: 354 - DNA, 21 bp, Artificial Sequence
  Description of Artificial Sequence: Synthetic oligonucleotide
  modified_base (4)..(4): 2'-O-methyluridine-5'-phosphate
  modified_base (12)..(12): 2'-O-methyluridine-5'-phosphate
  modified_base (21)..(21): 2'-deoxy-thymidine-5'-phosphate-phosphorothioate
auunaauccgcnaggauuutt

SEQ ID NO: 355 - DNA, 21 bp, Artificial Sequence
  Description of Artificial Sequence: Synthetic oligonucleotide
  modified_base (3)..(3): 2'-O-methyluridine-5'-phosphate
  modified_base (4)..(5): 2'-O-methylcytidine-5'-phosphate
  modified_base (6)..(6): 2'-O-methyluridine-5'-phosphate
  modified_base (9)..(9): 2'-O-methylcytidine-5'-phosphate
  modified_base (13)..(14): 2'-O-methyluridine-5'-phosphate
  modified_base (18)..(18): 2'-O-methyluridine-5'-phosphate
  modified_base (21)..(21): 2'-deoxy-thymidine-5'-phosphate-phosphorothioate
aannnnagnggannaaangtt

SEQ ID NO: 356 - DNA, 21 bp, Artificial Sequence
  Description of Artificial Sequence: Synthetic oligonucleotide
  modified_base (1)..(1): 2'-O-methylcytidine-5'-phosphate
  modified_base (5)..(5): 2'-O-methyluridine-5'-phosphate
  modified_base (13)..(13): 2'-O-methyluridine-5'-phosphate
  modified_base (21)..(21): 2'-deoxy-thymidine-5'-phosphate-phosphorothioate
nauunaauccgcnaggauutt

SEQ ID NO: 357 - DNA, 21 bp, Artificial Sequence
  Description of Artificial Sequence: Synthetic oligonucleotide
  modified_base (3)..(4): 2'-O-methyluridine-5'-phosphate
  modified_base (6)..(6): 2'-O-methyluridine-5'-phosphate
  modified_base (8)..(8): 2'-O-methylcytidine-5'-phosphate
  modified_base (10)..(10): 2'-O-methylcytidine-5'-phosphate
  modified_base (15)..(16): 2'-O-methylcytidine-5'-phosphate
  modified_base (18)..(18): 2'-O-methyluridine-5'-phosphate
  modified_base (19)..(19): 2'-O-methylcytidine-5'-phosphate
  modified_base (21)..(21): 2'-deoxy-thymidine-5'-phosphate-phosphorothioate
ganngnangnaggannanntt

SEQ ID NO: 358 - DNA, 21 bp, Artificial Sequence
  Description of Artificial Sequence: Synthetic oligonucleotide
  modified_base (13)..(13): 2'-O-methyluridine-5'-phosphate
  modified_base (15)..(15): 2'-O-methylcytidine-5'-phosphate
  modified_base (21)..(21): 2'-deoxy-thymidine-5'-phosphate-phosphorothioate
gaugguccugcgnanaauctt

SEQ ID NO: 359 - DNA, 21 bp, Artificial Sequence
  Description of Artificial Sequence: Synthetic oligonucleotide
  modified_base (3)..(3): 2'-O-methylcytidine-5'-phosphate
  modified_base (4)..(4): 2'-O-methyluridine-5'-phosphate
  modified_base (5)..(6): 2'-O-methylcytidine-5'-phosphate
  modified_base (7)..(7): 2'-O-methyluridine-5'-phosphate
  modified_base (9)..(10): 2'-O-methyluridine-5'-phosphate
  modified_base (12)..(12): 2'-O-methyluridine-5'-phosphate
  modified_base (16)..(16): 2'-O-methyluridine-5'-phosphate
  modified_base (17)..(17): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
aannnnngnnangagnngntt

SEQ ID NO: 360 - DNA, 21 bp, Artificial Sequence
  Description of Artificial Sequence: Synthetic oligonucleotide
  modified_base (7)..(7): 2'-O-methylcytidine-5'-phosphate
  modified_base (9)..(9): 2'-O-methyluridine-5'-phosphate
  modified_base (12)..(12): 2'-O-methylcytidine-5'-phosphate
  modified_base (21)..(21): 2'-deoxy-thymidine-5'-phosphate-phosphorothioate
acgacunanaanaggaguutt

SEQ ID NO: 361 - DNA, 21 bp, Artificial Sequence
  Description of Artificial Sequence: Synthetic oligonucleotide
  modified_base (1)..(3): 2'-O-methyluridine-5'-phosphate
  modified_base (5)..(5): 2'-O-methylcytidine-5'-phosphate
  modified_base (8)..(9): 2'-O-methylcytidine-5'-phosphate
  modified_base (12)..(12): 2'-O-methyluridine-5'-phosphate
  modified_base (14)..(14): 2'-O-methyluridine-5'-phosphate
  modified_base (15)..(15): 2'-O-methylcytidine-5'-phosphate
  modified_base (16)..(19): 2'-O-methyluridine-5'-phosphate
  modified_base (21)..(21): 2'-deoxy-thymidine-5'-phosphate-phosphorothioate
nnngnggnnganannnnnntt

SEQ ID NO: 362 - DNA, 21 bp, Artificial Sequence
  Description of Artificial Sequence: Synthetic oligonucleotide
  modified_base (7)..(7): 2'-O-methyluridine-5'-phosphate
  modified_base (16)..(16): 2'-O-methylcytidine-5'-phosphate
  modified_base (21)..(21): 2'-deoxy-thymidine-5'-phosphate-phosphorothioate
aaaaganaucggccgnaaatt

SEQ ID NO: 363 - DNA, 21 bp, Artificial Sequence
  Description of Artificial Sequence: Synthetic oligonucleotide
  modified_base (3)..(3): 2'-O-methyluridine-5'-phosphate
  modified_base (5)..(5): 2'-O-methylcytidine-5'-phosphate
  modified_base (8)..(8): 2'-O-methylcytidine-5'-phosphate
  modified_base (11)..(11): 2'-O-methyluridine-5'-phosphate
  modified_base (12)..(12): 2'-O-methylcytidine-5'-phosphate
  modified_base (15)..(15): 2'-O-methyluridine-5'-phosphate
  modified_base (17)..(17): 2'-O-methylcytidine-5'-phosphate
  modified_base (21)..(21): 2'-deoxy-thymidine-5'-phosphate-phosphorothioate
ggnanaangannaananagtt

SEQ ID NO: 364 - DNA, 21 bp, Artificial Sequence
  Description of Artificial Sequence: Synthetic oligonucleotide
  modified_base (4)..(4): 2'-O-methyluridine-5'-phosphate
  modified_base (16)..(16): 2'-O-methyluridine-5'-phosphate
  modified_base (21)..(21): 2'-deoxy-thymidine-5'-phosphate-phosphorothioate
cugnauugaucguugnacctt

SEQ ID NO: 365 - DNA, 21 bp, Artificial Sequence
  Description of Artificial Sequence: Synthetic oligonucleotide
  modified_base (1)..(1): 2'-O-methyluridine-5'-phosphate
  modified_base (4)..(5): 2'-O-methylcytidine-5'-phosphate
  modified_base (8)..(8): 2'-O-methyluridine-5'-phosphate
  modified_base (9)..(9): 2'-O-methylcytidine-5'-phosphate
  modified_base (11)..(11): 2'-O-methyluridine-5'-phosphate
  modified_base (13)..(13): 2'-O-methyluridine-5'-phosphate
  modified_base (17)..(17): 2'-O-methyluridine-5'-phosphate
  modified_base (21)..(21): 2'-deoxy-thymidine-5'-phosphate-phosphorothioate
nggnnaanngnangagnaatt

SEQ ID NO: 366 - DNA, 21 bp, Artificial Sequence
  Description of Artificial Sequence: Synthetic oligonucleotide
  modified_base (2)..(2): 2'-O-methyluridine-5'-phosphate
  modified_base (6)..(6): 2'-O-methylcytidine-5'-phosphate
  modified_base (8)..(8): 2'-O-methyluridine-5'-phosphate
  modified_base (18)..(18): 2'-O-methylcytidine-5'-phosphate
  modified_base (21)..(21): 2'-deoxy-thymidine-5'-phosphate-phosphorothioate
unacunanacgauuggcnatt

SEQ ID NO: 367 - DNA, 21 bp, Artificial Sequence
  Description of Artificial Sequence: Synthetic oligonucleotide
  modified_base (2)..(2): 2'-O-methyluridine-5'-phosphate
  modified_base (3)..(3): 2'-O-methylcytidine-5'-phosphate
  modified_base (4)..(4): 2'-O-methyluridine-5'-phosphate
  modified_base (6)..(6): 2'-O-methylcytidine-5'-phosphate
  modified_base (8)..(8): 2'-O-methylcytidine-5'-phosphate
  modified_base (10)..(10): 2'-O-methylcytidine-5'-phosphate
  modified_base (13)..(13): 2'-O-methylcytidine-5'-phosphate
  modified_base (16)..(16): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
gnnngnangnganagnaantt

SEQ ID NO: 368 - DNA, 21 bp, Artificial Sequence
  Description of Artificial Sequence: Synthetic oligonucleotide
  modified_base (15)..(15): 2'-O-methylcytidine-5'-phosphate
  modified_base (21)..(21): 2'-deoxy-thymidine-5'-phosphate-phosphorothioate
auugcugucgcgugnagactt

SEQ ID NO: 369 - DNA, 21 bp, Artificial Sequence
  Description of Artificial Sequence: Synthetic oligonucleotide
  modified_base (1)..(1): 2'-O-methylcytidine-5'-phosphate
  modified_base (2)..(2): 2'-O-methyluridine-5'-phosphate
  modified_base (4)..(5): 2'-O-methylcytidine-5'-phosphate
  modified_base (7)..(7): 2'-O-methylcytidine-5'-phosphate
  modified_base (9)..(9): 2'-O-methyluridine-5'-phosphate
  modified_base (10)..(10): 2'-O-methylcytidine-5'-phosphate
  modified_base (12)..(12): 2'-O-methylcytidine-5'-phosphate
  modified_base (13)..(13): 2'-O-methyluridine-5'-phosphate
  modified_base (14)..(14): 2'-O-methylcytidine-5'-phosphate
  modified_base (16)..(17): 2'-O-methyluridine-5'-phosphate
  modified_base (19)..(19): 2'-O-methylcytidine-5'-phosphate
  modified_base (21)..(21): 2'-deoxy-thymidine-5'-phosphate-phosphorothioate
nnannananngnnnanngntt

SEQ ID NO: 370 - DNA, 21 bp, Artificial Sequence
  Description of Artificial Sequence: Synthetic oligonucleotide
  modified_base (2)..(2): 2'-O-methylcytidine-5'-phosphate
  modified_base (17)..(17): 2'-O-methyluridine-5'-phosphate
  modified_base (21)..(21): 2'-deoxy-thymidine-5'-phosphate-phosphorothioate
gnaaugagcgauguggnagtt

SEQ ID NO: 371 - DNA, 21 bp, Artificial Sequence
  Description of Artificial Sequence: Synthetic oligonucleotide
  modified_base (1)..(1): 2'-O-methylcytidine-5'-phosphate
  modified_base (3)..(3): 2'-O-methylcytidine-5'-phosphate
  modified_base (4)..(4): 2'-O-methyluridine-5'-phosphate
  modified_base (5)..(5): 2'-O-methylcytidine-5'-phosphate
  modified_base (7)..(8): 2'-O-methyluridine-5'-phosphate
  modified_base (10)..(10): 2'-O-methylcytidine-5'-phosphate
  modified_base (14)..(14): 2'-O-methyluridine-5'-phosphate
  modified_base (16)..(16): 2'-O-methylcytidine-5'-phosphate
  modified_base (17)..(18): 2'-O-methyluridine-5'-phosphate
  modified_base (21)..(21): 2'-deoxy-thymidine-5'-phosphate-phosphorothioate
ngnnnanngngaanannnatt

SEQ ID NO: 372 - DNA, 21 bp, Artificial Sequence
  Description of Artificial Sequence: Synthetic oligonucleotide
  modified_base (1)..(1): 2'-O-methyluridine-5'-phosphate
  modified_base (5)..(5): 2'-O-methyluridine-5'-phosphate
  modified_base (11)..(11): 2'-O-methylcytidine-5'-phosphate
  modified_base (21)..(21): 2'-deoxy-thymidine-5'-phosphate-phosphorothioate
naagnauucgnaaugagcgtt

SEQ ID NO: 373 - DNA, 21 bp, Artificial Sequence
  Description of Artificial Sequence: Synthetic oligonucleotide
  modified_base (2)..(3): 2'-O-methyluridine-5'-phosphate
  modified_base (5)..(5): 2'-O-methylcytidine-5'-phosphate
  modified_base (9)..(9): 2'-O-methyluridine-5'-phosphate
  modified_base (11)..(11): 2'-O-methylcytidine-5'-phosphate
  modified_base (12)..(13): 2'-O-methyluridine-5'-phosphate
  modified_base (17)..(18): 2'-O-methylcytidine-5'-phosphate
  modified_base (21)..(21): 2'-deoxy-thymidine-5'-phosphate-phosphorothioate
anngngaanannnaagnnatt

SEQ ID NO: 374 - DNA, 21 bp, Artificial Sequence
  Description of Artificial Sequence: Synthetic oligonucleotide
  modified_base (6)..(6): 2'-O-methyluridine-5'-phosphate
  modified_base (10)..(10): 2'-O-methyluridine-5'-phosphate
  modified_base (16)..(16): 2'-O-methylcytidine-5'-phosphate
  modified_base (21)..(21): 2'-deoxy-thymidine-5'-phosphate-phosphorothioate
uggcunaagnauucgnaautt

SEQ ID NO: 375 - DNA, 21 bp, Artificial Sequence
  Description of Artificial Sequence: Synthetic oligonucleotide
  modified_base (2)..(2): 2'-O-methylcytidine-5'-phosphate
  modified_base (6)..(6): 2'-O-methyluridine-5'-phosphate
  modified_base (8)..(8): 2'-O-methylcytidine-5'-phosphate
  modified_base (9)..(10): 2'-O-methyluridine-5'-phosphate
  modified_base (14)..(15): 2'-O-methylcytidine-5'-phosphate
  modified_base (18)..(18): 2'-O-methylcytidine-5'-phosphate
  modified_base (21)..(21): 2'-deoxy-thymidine-5'-phosphate-phosphorothioate
gngaanannnaagnnaanatt

SEQ ID NO: 376 - DNA, 21 bp, Artificial Sequence
  Description of Artificial Sequence: Synthetic oligonucleotide
  modified_base (9)..(9): 2'-O-methyluridine-5'-phosphate
  modified_base (13)..(13): 2'-O-methyluridine-5'-phosphate
  modified_base (21)..(21): 2'-deoxy-thymidine-5'-phosphate-phosphorothioate
uguuggcunaagnauucgctt

SEQ ID NO: 377 - DNA, 21 bp, Artificial Sequence
  Description of Artificial Sequence: Synthetic oligonucleotide
  modified_base (2)..(2): 2'-O-methyluridine-5'-phosphate
  modified_base (4)..(4): 2'-O-methyluridine-5'-phosphate
  modified_base (5)..(5): 2'-O-methylcytidine-5'-phosphate
  modified_base (7)..(7): 2'-O-methylcytidine-5'-phosphate
  modified_base (10)..(11): 2'-O-methyluridine-5'-phosphate
  modified_base (14)..(14): 2'-O-methyluridine-5'-phosphate
  modified_base (18)..(18): 2'-O-methyluridine-5'-phosphate
  modified_base (21)..(21): 2'-deoxy-thymidine-5'-phosphate-phosphorothioate
angnnanggnnaangagnatt

SEQ ID NO: 378 - DNA, 21 bp, Artificial Sequence
  Description of Artificial Sequence: Synthetic oligonucleotide
  modified_base (1)..(1): 2'-O-methyluridine-5'-phosphate
  modified_base (5)..(5): 2'-O-methylcytidine-5'-phosphate
  modified_base (8)..(8): 2'-O-methyluridine-5'-phosphate
  modified_base (17)..(17): 2'-O-methylcytidine-5'-phosphate
  modified_base (21)..(21): 2'-deoxy-thymidine-5'-phosphate-phosphorothioate
nacunaunaaccguganautt

SEQ ID NO: 379 - DNA, 21 bp, Artificial Sequence
  Description of Artificial Sequence: Synthetic oligonucleotide
  modified_base (3)..(4): 2'-O-methyluridine-5'-phosphate
  modified_base (7)..(7): 2'-O-methyluridine-5'-phosphate
  modified_base (8)..(8): 2'-O-methylcytidine-5'-phosphate
  modified_base (10)..(10): 2'-O-methylcytidine-5'-phosphate
  modified_base (15)..(15): 2'-O-methylcytidine-5'-phosphate
  modified_base (18)..(19): 2'-O-methyluridine-5'-phosphate
  modified_base (21)..(21): 2'-deoxy-thymidine-5'-phosphate-phosphorothioate
aannaanngnggaanaanntt

SEQ ID NO: 380 - DNA, 21 bp, Artificial Sequence
  Description of Artificial Sequence: Synthetic oligonucleotide
  modified_base (15)..(15): 2'-O-methyluridine-5'-phosphate
  modified_base (21)..(21): 2'-deoxy-thymidine-5'-phosphate-phosphorothioate
aauuguuccgcgaunaauutt

SEQ ID NO: 381 - DNA, 21 bp, Artificial Sequence
  Description of Artificial Sequence: Synthetic oligonucleotide
  modified_base (3)..(5): 2'-O-methyluridine-5'-phosphate
  modified_base (6)..(6): 2'-O-methylcytidine-5'-phosphate
  modified_base (9)..(9): 2'-O-methyluridine-5'-phosphate
  modified_base (10)..(10): 2'-O-methylcytidine-5'-phosphate
  modified_base (13)..(13): 2'-O-methyluridine-5'-phosphate
  modified_base (14)..(14): 2'-O-methylcytidine-5'-phosphate
  modified_base (19)..(19): 2'-O-methylcytidine-5'-phosphate
  modified_base (21)..(21): 2'-deoxy-thymidine-5'-phosphate-phosphorothioate
aannnngannganngagantt

SEQ ID NO: 382 - DNA, 21 bp, Artificial Sequence
  Description of Artificial Sequence: Synthetic oligonucleotide
  modified_base (18)..(18): 2'-O-methyluridine-5'-phosphate
  modified_base (21)..(21): 2'-deoxy-thymidine-5'-phosphate-phosphorothioate
gucucgaucgaucgaaanutt

SEQ ID NO: 383 - DNA, 21 bp, Artificial Sequence
  Description of Artificial Sequence: Synthetic oligonucleotide
  modified_base (4)..(4): 2'-O-methylcytidine-5'-phosphate
  modified_base (6)..(6): 2'-O-methylcytidine-5'-phosphate
  modified_base (8)..(9): 2'-O-methylcytidine-5'-phosphate
  modified_base (12)..(13): 2'-O-methyluridine-5'-phosphate
  modified_base (16)..(16): 2'-O-methylcytidine-5'-phosphate
  modified_base (18)..(18): 2'-O-methyluridine-5'-phosphate
  modified_base (19)..(19): 2'-O-methylcytidine-5'-phosphate
  modified_base (21)..(21): 2'-deoxy-thymidine-5'-phosphate-phosphorothioate
gganangnnaannaangnntt

SEQ ID NO: 384 - DNA, 21 bp, Artificial Sequence
  Description of Artificial Sequence: Synthetic oligonucleotide
  modified_base (6)..(6): 2'-O-methyluridine-5'-phosphate
  modified_base (21)..(21): 2'-deoxy-thymidine-5'-phosphate-phosphorothioate
gacgunaauuggcgugucctt

SEQ ID NO: 385 - DNA, 21 bp, Artificial Sequence
  Description of Artificial Sequence: Synthetic oligonucleotide
  modified_base (2)..(2): 2'-O-methylcytidine-5'-phosphate
  modified_base (4)..(4): 2'-O-methylcytidine-5'-phosphate
  modified_base (5)..(5): 2'-O-methyluridine-5'-phosphate
  modified_base (8)..(8): 2'-O-methylcytidine-5'-phosphate
  modified_base (9)..(9): 2'-O-methyluridine-5'-phosphate
  modified_base (11)..(11): 2'-O-methylcytidine-5'-phosphate
  modified_base (12)..(12): 2'-O-methyluridine-5'-phosphate
  modified_base (16)..(16): 2'-O-methyluridine-5'-phosphate
  modified_base (17)..(18): 2'-O-methylcytidine-5'-phosphate
  modified_base (21)..(21): 2'-deoxy-thymidine-5'-phosphate-phosphorothioate
angnnagnnanngagnnnatt

SEQ ID NO: 386 - DNA, 21 bp, Artificial Sequence
  Description of Artificial Sequence: Synthetic oligonucleotide
  modified_base (7)..(7): 2'-O-methylcytidine-5'-phosphate
  modified_base (10)..(10): 2'-O-methyluridine-5'-phosphate
  modified_base (14)..(14): 2'-O-methyluridine-5'-phosphate
  modified_base (21)..(21): 2'-deoxy-thymidine-5'-phosphate-phosphorothioate
uggacunagnagcnagcgutt

SEQ ID NO: 387 - DNA, 21 bp, Artificial Sequence
  Description of Artificial Sequence: Synthetic oligonucleotide
  modified_base (1)..(1): 2'-O-methylcytidine-5'-phosphate
  modified_base (2)..(2): 2'-O-methyluridine-5'-phosphate
  modified_base (6)..(6): 2'-O-methylcytidine-5'-phosphate
  modified_base (10)..(10): 2'-O-methyluridine-5'-phosphate
  modified_base (11)..(11): 2'-O-methylcytidine-5'-phosphate
  modified_base (16)..(17): 2'-O-methyluridine-5'-phosphate
  modified_base (19)..(19): 2'-O-methyluridine-5'-phosphate
  modified_base (21)..(21): 2'-deoxy-thymidine-5'-phosphate-phosphorothioate
nnaagnaagnngaggnnantt

SEQ ID NO: 388 - DNA, 21 bp, Artificial Sequence
  Description of Artificial Sequence: Synthetic oligonucleotide
  modified_base (2)..(2): 2'-O-methyluridine-5'-phosphate
  modified_base (17)..(17): 2'-O-methyluridine-5'-phosphate
  modified_base (21)..(21): 2'-deoxy-thymidine-5'-phosphate-phosphorothioate
anaaccucgacuugcunagtt

SEQ ID NO: 389 - DNA, 21 bp, Artificial Sequence
  Description of Artificial Sequence: Synthetic oligonucleotide
  modified_base (3)..(4): 2'-O-methyluridine-5'-phosphate
  modified_base (6)..(6): 2'-O-methyluridine-5'-phosphate
  modified_base (8)..(8): 2'-O-methyluridine-5'-phosphate
  modified_base (9)..(10): 2'-O-methylcytidine-5'-phosphate
  modified_base (12)..(13): 2'-O-methylcytidine-5'-phosphate
  modified_base (14)..(15): 2'-O-methyluridine-5'-phosphate
  modified_base (18)..(19): 2'-O-methyluridine-5'-phosphate
  modified_base (21)..(21): 2'-deoxy-thymidine-5'-phosphate-phosphorothioate
agnnanannngnnnnggnntt

SEQ ID NO: 390 - DNA, 21 bp, Artificial Sequence
  Description of Artificial Sequence: Synthetic oligonucleotide
  modified_base (4)..(4): 2'-O-methylcytidine-5'-phosphate
  modified_base (13)..(13): 2'-O-methyluridine-5'-phosphate
  modified_base (15)..(15): 2'-O-methyluridine-5'-phosphate
  modified_base (21)..(21): 2'-deoxy-thymidine-5'-phosphate-phosphorothioate
aacnaaggcggananaacutt

SEQ ID NO: 391 - DNA, 21 bp, Artificial Sequence
  Description of Artificial Sequence: Synthetic oligonucleotide
  modified_base (1)..(1): 2'-O-methylcytidine-5'-phosphate
  modified_base (5)..(5): 2'-O-methyluridine-5'-phosphate
  modified_base (7)..(7): 2'-O-methyluridine-5'-phosphate
  modified_base (10)..(11): 2'-O-methylcytidine-5'-phosphate
  modified_base (12)..(12): 2'-O-methyluridine-5'-phosphate
  modified_base (13)..(13): 2'-O-methylcytidine-5'-phosphate
  modified_base (15)..(15): 2'-O-methyluridine-5'-phosphate
  modified_base (16)..(16): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
naggnanaannnngnngantt

SEQ ID NO: 392 - DNA, 21 bp, Artificial Sequence
  Description of Artificial Sequence: Synthetic oligonucleotide
  modified_base (12)..(12): 2'-O-methyluridine-5'-phosphate
  modified_base (14)..(14): 2'-O-methyluridine-5'-phosphate
  modified_base (21)..(21): 2'-deoxy-thymidine-5'-phosphate-phosphorothioate
aucgacgaggunanaccugtt

SEQ ID NO: 393 - DNA, 21 bp, Artificial Sequence
  Description of Artificial Sequence: Synthetic oligonucleotide
  modified_base (4)..(4): 2'-O-methyluridine-5'-phosphate
  modified_base (6)..(6): 2'-O-methyluridine-5'-phosphate
  modified_base (9)..(10): 2'-O-methylcytidine-5'-phosphate
  modified_base (11)..(11): 2'-O-methyluridine-5'-phosphate
  modified_base (12)..(12): 2'-O-methylcytidine-5'-phosphate
  modified_base (14)..(14): 2'-O-methyluridine-5'-phosphate
  modified_base (15)..(15): 2'-O-methylcytidine-5'-phosphate
  modified_base (18)..(19): 2'-O-methyluridine-5'-phosphate
  modified_base (21)..(21): 2'-deoxy-thymidine-5'-phosphate-phosphorothioate
aggnanaannnngnnganntt

SEQ ID NO: 394 - DNA, 21 bp, Artificial Sequence
  Description of Artificial Sequence: Synthetic oligonucleotide
  modified_base (13)..(13): 2'-O-methyluridine-5'-phosphate
  modified_base (15)..(15): 2'-O-methyluridine-5'-phosphate
  modified_base (21)..(21): 2'-deoxy-thymidine-5'-phosphate-phosphorothioate
aaucgacgaggunanaccutt

SEQ ID NO: 395 - DNA, 21 bp, Artificial Sequence
  Description of Artificial Sequence: Synthetic oligonucleotide
  modified_base (2)..(2): 2'-O-methylcytidine-5'-phosphate
  modified_base (3)..(3): 2'-O-methyluridine-5'-phosphate
  modified_base (5)..(5): 2'-O-methylcytidine-5'-phosphate
  modified_base (11)..(12): 2'-O-methyluridine-5'-phosphate
  modified_base (13)..(13): 2'-O-methylcytidine-5'-phosphate
  modified_base (16)..(16): 2'-O-methylcytidine-5'-phosphate
  modified_base (17)..(17): 2'-O-methyluridine-5'-phosphate
  modified_base (21)..(21): 2'-deoxy-thymidine-5'-phosphate-phosphorothioate
annangaggannnggnngatt

SEQ ID NO: 396 - DNA, 21 bp, Artificial Sequence
  Description of Artificial Sequence: Synthetic oligonucleotide
  modified_base (2)..(2): 2'-O-methylcytidine-5'-phosphate
  modified_base (16)..(16): 2'-O-methyluridine-5'-phosphate
  modified_base (21)..(21): 2'-deoxy-thymidine-5'-phosphate-phosphorothioate
unagccgaauccucgnagutt

SEQ ID NO: 397 - DNA, 21 bp, Artificial Sequence
  Description of Artificial Sequence: Synthetic oligonucleotide
  modified_base (1)..(1): 2'-O-methyluridine-5'-phosphate
  modified_base (2)..(2): 2'-O-methylcytidine-5'-phosphate
  modified_base (3)..(3): 2'-O-methyluridine-5'-phosphate
  modified_base (5)..(7): 2'-O-methylcytidine-5'-phosphate
  modified_base (11)..(11): 2'-O-methylcytidine-5'-phosphate
  modified_base (12)..(13): 2'-O-methyluridine-5'-phosphate
  modified_base (15)..(15): 2'-O-methyluridine-5'-phosphate
  modified_base (16)..(16): 2'-O-methylcytidine-5'-phosphate
  modified_base (18)..(19): 2'-O-methyluridine-5'-phosphate
  modified_base (21)..(21): 2'-deoxy-thymidine-5'-phosphate-phosphorothioate
nnnannnaaannngnngnntt

SEQ ID NO: 398 - DNA, 21 bp, Artificial Sequence
  Description of Artificial Sequence: Synthetic oligonucleotide
  modified_base (6)..(6): 2'-O-methylcytidine-5'-phosphate
  modified_base (16)..(16): 2'-O-methyluridine-5'-phosphate
  modified_base (21)..(21): 2'-deoxy-thymidine-5'-phosphate-phosphorothioate
aacganaaguuugggnagatt

SEQ ID NO: 399 - DNA, 21 bp, Artificial Sequence
  Description of Artificial Sequence: Synthetic oligonucleotide
  modified_base (1)..(1): 2'-O-methylcytidine-5'-phosphate
  modified_base (2)..(2): 2'-O-methyluridine-5'-phosphate
  modified_base (4)..(4): 2'-O-methylcytidine-5'-phosphate
  modified_base (10)..(11): 2'-O-methyluridine-5'-phosphate
  modified_base (12)..(12): 2'-O-methylcytidine-5'-phosphate
  modified_base (15)..(15): 2'-O-methylcytidine-5'-phosphate
  modified_base (16)..(16): 2'-O-methyluridine-5'-phosphate
  modified_base (21)..(21): 2'-deoxy-thymidine-5'-phosphate-phosphorothioate
nnangaggannnggnngaatt

SEQ ID NO: 400 - DNA, 21 bp, Artificial Sequence
  Description of Artificial Sequence: Synthetic oligonucleotide
  modified_base (3)..(3): 2'-O-methylcytidine-5'-phosphate
  modified_base (17)..(17): 2'-O-methyluridine-5'-phosphate
  modified_base (21)..(21): 2'-deoxy-thymidine-5'-phosphate-phosphorothioate
uunagccgaauccucgnagtt

SEQ ID NO: 401 - DNA, 21 bp, Artificial Sequence
  Description of Artificial Sequence: Synthetic oligonucleotide
  modified_base (1)..(2): 2'-O-methylcytidine-5'-phosphate
  modified_base (3)..(3): 2'-O-methyluridine-5'-phosphate
  modified_base (6)..(6): 2'-O-methylcytidine-5'-phosphate
  modified_base (7)..(7): 2'-O-methyluridine-5'-phosphate
  modified_base (9)..(9): 2'-O-methylcytidine-5'-phosphate
  modified_base (15)..(16): 2'-O-methyluridine-5'-phosphate
  modified_base (17)..(17): 2'-O-methylcytidine-5'-phosphate
  modified_base (21)..(21): 2'-deoxy-thymidine-5'-phosphate-phosphorothioate
nnngannangaggannnggtt

SEQ ID NO: 402 - DNA, 21 bp, Artificial Sequence
  Description of Artificial Sequence: Synthetic oligonucleotide
  modified_base (12)..(12): 2'-O-methyluridine-5'-phosphate
  modified_base (16)..(16): 2'-O-methylcytidine-5'-phosphate
  modified_base (21)..(21): 2'-deoxy-thymidine-5'-phosphate-phosphorothioate
ccgaauccucgnagunaggtt

SEQ ID NO: 403 - DNA, 21 bp, Artificial Sequence
  Description of Artificial Sequence: Synthetic oligonucleotide
  modified_base (2)..(2): 2'-O-methylcytidine-5'-phosphate
  modified_base (8)..(9): 2'-O-methyluridine-5'-phosphate
  modified_base (10)..(10): 2'-O-methylcytidine-5'-phosphate
  modified_base (13)..(13): 2'-O-methylcytidine-5'-phosphate
  modified_base (14)..(14): 2'-O-methyluridine-5'-phosphate
  modified_base (21)..(21): 2'-deoxy-thymidine-5'-phosphate-phosphorothioate
angaggannnggnngaaggtt

SEQ ID NO: 404 - DNA, 21 bp, Artificial Sequence
  Description of Artificial Sequence: Synthetic oligonucleotide
  modified_base (5)..(5): 2'-O-methylcytidine-5'-phosphate
  modified_base (21)..(21): 2'-deoxy-thymidine-5'-phosphate-phosphorothioate
ccuunagccgaauccucgutt

SEQ ID NO: 405 - DNA, 21 bp, Artificial Sequence
  Description of Artificial Sequence: Synthetic oligonucleotide
  modified_base (2)..(2): 2'-O-methylcytidine-5'-phosphate
  modified_base (8)..(8): 2'-O-methyluridine-5'-phosphate
  modified_base (9)..(9): 2'-O-methylcytidine-5'-phosphate
  modified_base (10)..(10): 2'-O-methyluridine-5'-phosphate
  modified_base (11)..(11): 2'-O-methylcytidine-5'-phosphate
  modified_base (13)..(13): 2'-O-methylcytidine-5'-phosphate
  modified_base (15)..(15): 2'-O-methyluridine-5'-phosphate
  modified_base (16)..(18): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
angagagnnnnanannnnntt

SEQ ID NO: 406 - DNA, 21 bp, Artificial Sequence
  Description of Artificial Sequence: Synthetic oligonucleotide
  modified_base (6)..(6): 2'-O-methyluridine-5'-phosphate
  modified_base (8)..(8): 2'-O-methyluridine-5'-phosphate
  modified_base (21)..(21): 2'-deoxy-thymidine-5'-phosphate-phosphorothioate
agggangngagacucucgutt

SEQ ID NO: 407 - DNA, 21 bp, Artificial Sequence
  Description of Artificial Sequence: Synthetic oligonucleotide
  modified_base (4)..(6): 2'-O-methyluridine-5'-phosphate
  modified_base (7)..(7): 2'-O-methylcytidine-5'-phosphate
  modified_base (11)..(11): 2'-O-methylcytidine-5'-phosphate
  modified_base (14)..(15): 2'-O-methylcytidine-5'-phosphate
  modified_base (16)..(17): 2'-O-methyluridine-5'-phosphate
  modified_base (19)..(19): 2'-O-methylcytidine-5'-phosphate
  modified_base (21)..(21): 2'-deoxy-thymidine-5'-phosphate-phosphorothioate
aaannnngggngannnnantt

SEQ ID NO: 408 - DNA, 21 bp, Artificial Sequence
  Description of Artificial Sequence: Synthetic oligonucleotide
  modified_base (2)..(2): 2'-O-methyluridine-5'-phosphate
  modified_base (21)..(21): 2'-deoxy-thymidine-5'-phosphate-phosphorothioate
gnaaggucgcccgaaauuutt

SEQ ID NO: 409 - DNA, 21 bp, Artificial Sequence
  Description of Artificial Sequence: Synthetic oligonucleotide
  modified_base (1)..(1): 2'-O-methyluridine-5'-phosphate
  modified_base (2)..(2): 2'-O-methylcytidine-5'-phosphate
  modified_base (6)..(6): 2'-O-methylcytidine-5'-phosphate
  modified_base (9)..(10): 2'-O-methylcytidine-5'-phosphate
  modified_base (11)..(12): 2'-O-methyluridine-5'-phosphate
  modified_base (14)..(14): 2'-O-methylcytidine-5'-phosphate
  modified_base (16)..(18): 2'-O-methyluridine-5'-phosphate
  modified_base (19)..(19): 2'-O-methylcytidine-5'-phosphate
  modified_base (21)..(21): 2'-deoxy-thymidine-5'-phosphate-phosphorothioate
nngggngannnnanannnntt

SEQ ID NO: 410 - DNA, 21 bp, Artificial Sequence
  Description of Artificial Sequence: Synthetic oligonucleotide
  modified_base (7)..(7): 2'-O-methyluridine-5'-phosphate
  modified_base (21)..(21): 2'-deoxy-thymidine-5'-phosphate-phosphorothioate
gaaaugnaaggucgcccgatt

SEQ ID NO: 411 - DNA, 21 bp, Artificial Sequence
  Description of Artificial Sequence: Synthetic oligonucleotide
  modified_base (1)..(1): 2'-O-methyluridine-5'-phosphate
  modified_base (4)..(5): 2'-O-methylcytidine-5'-phosphate
  modified_base (8)..(8): 2'-O-methylcytidine-5'-phosphate
  modified_base (13)..(13): 2'-O-methyluridine-5'-phosphate
  modified_base (15)..(16): 2'-O-methylcytidine-5'-phosphate
  modified_base (18)..(18): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
ngannggnaaaananngnntt

SEQ ID NO: 412 - DNA, 21 bp, Artificial Sequence
  Description of Artificial Sequence: Synthetic oligonucleotide
  modified_base (6)..(6): 2'-O-methyluridine-5'-phosphate
  modified_base (18)..(18): 2'-O-methylcytidine-5'-phosphate
  modified_base (21)..(21): 2'-deoxy-thymidine-5'-phosphate-phosphorothioate
agcggnauuuugccggunatt

SEQ ID NO: 413 - DNA, 21 bp, Artificial Sequence
  Description of Artificial Sequence: Synthetic oligonucleotide
  modified_base (1)..(2): 2'-O-methylcytidine-5'-phosphate
  modified_base (5)..(5): 2'-O-methylcytidine-5'-phosphate
  modified_base (10)..(10): 2'-O-methyluridine-5'-phosphate
  modified_base (12)..(13): 2'-O-methylcytidine-5'-phosphate
  modified_base (15)..(15): 2'-O-methylcytidine-5'-phosphate
  modified_base (16)..(16): 2'-O-methyluridine-5'-phosphate
  modified_base (19)..(19): 2'-O-methylcytidine-5'-phosphate
  modified_base (21)..(21): 2'-deoxy-thymidine-5'-phosphate-phosphorothioate
nnggnaaaananngnnaantt

SEQ ID NO: 414 - DNA, 21 bp, Artificial Sequence
  Description of Artificial Sequence: Synthetic oligonucleotide
  modified_base (3)..(3): 2'-O-methyluridine-5'-phosphate
  modified_base (9)..(9): 2'-O-methyluridine-5'-phosphate
  modified_base (21)..(21): 2'-deoxy-thymidine-5'-phosphate-phosphorothioate
gunagcggnauuuugccggtt

SEQ ID NO: 415 - DNA, 21 bp, Artificial Sequence
  Description of Artificial Sequence: Synthetic oligonucleotide
  modified_base (3)..(3): 2'-O-methylcytidine-5'-phosphate
  modified_base (4)..(4): 2'-O-methyluridine-5'-phosphate
  modified_base (6)..(6): 2'-O-methyluridine-5'-phosphate
  modified_base (8)..(8): 2'-O-methylcytidine-5'-phosphate
  modified_base (10)..(10): 2'-O-methyluridine-5'-phosphate
  modified_base (11)..(11): 2'-O-methylcytidine-5'-phosphate
  modified_base (14)..(14): 2'-O-methylcytidine-5'-phosphate
  modified_base (18)..(19): 2'-O-methylcytidine-5'-phosphate
  modified_base (21)..(21): 2'-deoxy-thymidine-5'-phosphate-phosphorothioate
agnngngngnnggnaaanntt

SEQ ID NO: 416 - DNA, 21 bp, Artificial Sequence
  Description of Artificial Sequence: Synthetic oligonucleotide
  modified_base (13)..(13): 2'-O-methylcytidine-5'-phosphate
  modified_base (15)..(15): 2'-O-methylcytidine-5'-phosphate
  modified_base (21)..(21): 2'-deoxy-thymidine-5'-phosphate-phosphorothioate
gguuugccgacgnanagcutt

SEQ ID NO: 417 - DNA, 21 bp, Artificial Sequence
  Description of Artificial Sequence: Synthetic oligonucleotide
  modified_base (2)..(3): 2'-O-methyluridine-5'-phosphate
  modified_base (10)..(10): 2'-O-methyluridine-5'-phosphate
  modified_base (11)..(12): 2'-O-methylcytidine-5'-phosphate
  modified_base (16)..(16): 2'-O-methylcytidine-5'-phosphate
  modified_base (21)..(21): 2'-deoxy-thymidine-5'-phosphate-phosphorothioate
anngaaagannngaangggtt

SEQ ID NO: 418 - DNA, 21 bp, Artificial Sequence
  Description of Artificial Sequence: Synthetic oligonucleotide
  modified_base (16)..(16): 2'-O-methylcytidine-5'-phosphate
  modified_base (21)..(21): 2'-O-methyluridine-5'-phosphate
cccguucggaucuuunaautt

SEQ ID NO: 419 - DNA, 21 bp, Artificial Sequence
  Description of Artificial Sequence: Synthetic oligonucleotide
  modified_base (3)..(5): 2'-O-methyluridine-5'-phosphate
  modified_base (6)..(6): 2'-O-methylcytidine-5'-phosphate
  modified_base (10)..(10): 2'-O-methylcytidine-5'-phosphate
  modified_base (13)..(14): 2'-O-methylcytidine-5'-phosphate
  modified_base (15)..(16): 2'-O-methyluridine-5'-phosphate
  modified_base (18)..(18): 2'-O-methylcytidine-5'-phosphate
  modified_base (21)..(21): 2'-O-methyluridine-5'-phosphate
aannnngggngannnnanatt

SEQ ID NO: 420 - DNA, 21 bp, Artificial Sequence
  Description of Artificial Sequence: Synthetic oligonucleotide
  modified_base (3)..(3): 2'-O-methyluridine-5'-phosphate
  modified_base (21)..(21): 2'-deoxy-thymidine-5'-phosphate-phosphorothioate
ugnaaggucgcccgaaauutt

SEQ ID NO: 421 - DNA, 21 bp, Artificial Sequence
  Description of Artificial Sequence: Synthetic oligonucleotide
  modified_base (2)..(4): 2'-O-methyluridine-5'-phosphate
  modified_base (5)..(5): 2'-O-methylcytidine-5'-phosphate
  modified_base (9)..(9): 2'-O-methylcytidine-5'-phosphate
  modified_base (12)..(13): 2'-O-methylcytidine-5'-phosphate
  modified_base (14)..(15): 2'-O-methyluridine-5'-phosphate
  modified_base (17)..(17): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
annnngggngannnnanantt

SEQ ID NO: 422 - DNA, 21 bp, Artificial Sequence
  Description of Artificial Sequence: Synthetic oligonucleotide
  modified_base (4)..(4): 2'-O-methyluridine-5'-phosphate
  modified_base (21)..(21): 2'-deoxy-thymidine-5'-phosphate-phosphorothioate
augnaaggucgcccgaaautt

SEQ ID NO: 423 - DNA, 21 bp, Artificial Sequence
  Description of Artificial Sequence: Synthetic oligonucleotide
  modified_base (2)..(2): 2'-O-methyluridine-5'-phosphate
  modified_base (3)..(3): 2'-O-methylcytidine-5'-phosphate
  modified_base (4)..(4): 2'-O-methyluridine-5'-phosphate
  modified_base (6)..(7): 2'-O-methyluridine-5'-phosphate
  modified_base (9)..(9): 2'-O-methyluridine-5'-phosphate
  modified_base (11)..(11): 2'-O-methyluridine-5'-phosphate
  modified_base (12)..(12): 2'-O-methylcytidine-5'-phosphate
  modified_base (14)..(14): 2'-O-methyluridine-5'-phosphate
  modified_base (18)..(18): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
gnnnanngngnnanaagnntt

SEQ ID NO: 424 - DNA, 21 bp, Artificial Sequence
  Description of Artificial Sequence: Synthetic oligonucleotide
  modified_base (5)..(5): 2'-O-methyluridine-5'-phosphate
  modified_base (10)..(10): 2'-O-methylcytidine-5'-phosphate
  modified_base (12)..(12): 2'-O-methylcytidine-5'-phosphate
  modified_base (15)..(15): 2'-O-methyluridine-5'-phosphate
  modified_base (21)..(21): 2'-deoxy-thymidine-5'-phosphate-phosphorothioate
agcunaugananaanagactt

SEQ ID NO: 425 - DNA, 21 bp, Artificial Sequence
  Description of Artificial Sequence: Synthetic oligonucleotide
  modified_base (1)..(1): 2'-O-methylcytidine-5'-phosphate
  modified_base (2)..(2): 2'-O-methyluridine-5'-phosphate
  modified_base (3)..(3): 2'-O-methylcytidine-5'-phosphate
  modified_base (5)..(5): 2'-O-methylcytidine-5'-phosphate
  modified_base (7)..(7): 2'-O-methyluridine-5'-phosphate
  modified_base (8)..(8): 2'-O-methylcytidine-5'-phosphate
  modified_base (9)..(10): 2'-O-methyluridine-5'-phosphate
  modified_base (12)..(12): 2'-O-methyluridine-5'-phosphate
  modified_base (14)..(14): 2'-O-methylcytidine-5'-phosphate
  modified_base (17)..(17): 2'-O-methyluridine-5'-phosphate
  modified_base (18)..(18): 2'-O-methylcytidine-5'-phosphate
  modified_base (21)..(21): 2'-deoxy-thymidine-5'-phosphate-phosphorothioate
nnngnannnnanangannatt

SEQ ID NO: 426 - DNA, 21 bp, Artificial Sequence
  Description of Artificial Sequence: Synthetic oligonucleotide
  modified_base (7)..(7): 2'-O-methyluridine-5'-phosphate
  modified_base (9)..(9): 2'-O-methyluridine-5'-phosphate
  modified_base (21)..(21): 2'-deoxy-thymidine-5'-phosphate-phosphorothioate
ugaucgnanaagaugcgagtt

SEQ ID NO: 427 - DNA, 21 bp, Artificial Sequence
  Description of Artificial Sequence: Synthetic oligonucleotide
  modified_base (1)..(1): 2'-O-methyluridine-5'-phosphate
  modified_base (3)..(3): 2'-O-methylcytidine-5'-phosphate
  modified_base (5)..(5): 2'-O-methyluridine-5'-phosphate
  modified_base (9)..(9): 2'-O-methylcytidine-5'-phosphate
  modified_base (12)..(12): 2'-O-methyluridine-5'-phosphate
  modified_base (13)..(14): 2'-O-methylcytidine-5'-phosphate
  modified_base (16)..(16): 2'-O-methyluridine-5'-phosphate
  modified_base (18)..(18): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
ngnanaagngannnananntt

SEQ ID NO: 428 - DNA, 21 bp, Artificial Sequence
  Description of Artificial Sequence: Synthetic oligonucleotide
  modified_base (3)..(3): 2'-O-methyluridine-5'-phosphate
  modified_base (14)..(14): 2'-O-methyluridine-5'-phosphate
  modified_base (18)..(18): 2'-O-methylcytidine-5'-phosphate
  modified_base (21)..(21): 2'-deoxy-thymidine-5'-phosphate-phosphorothioate
agnauggaucgcunaugnatt

SEQ ID NO: 429 - DNA, 21 bp, Artificial Sequence
  Description of Artificial Sequence: Synthetic oligonucleotide
  modified_base (3)..(3): 2'-O-methyluridine-5'-phosphate
  modified_base (5)..(5): 2'-O-methyluridine-5'-phosphate
  modified_base (7)..(7): 2'-O-methylcytidine-5'-phosphate
  modified_base (8)..(8): 2'-O-methyluridine-5'-phosphate
  modified_base (11)..(11): 2'-O-methyluridine-5'-phosphate
  modified_base (12)..(12): 2'-O-methylcytidine-5'-phosphate
  modified_base (16)..(16): 2'-O-methyluridine-5'-phosphate
  modified_base (17)..(17): 2'-O-methylcytidine-5'-phosphate
  modified_base (21)..(21): 2'-deoxy-thymidine-5'-phosphate-phosphorothioate
aangnannaanngggnnaatt

SEQ ID NO: 430 - DNA, 21 bp, Artificial Sequence
  Description of Artificial Sequence: Synthetic oligonucleotide
  modified_base (11)..(11): 2'-O-methyluridine-5'-phosphate
  modified_base (14)..(14): 2'-O-methyluridine-5'-phosphate
  modified_base (16)..(16): 2'-O-methylcytidine-5'-phosphate
  modified_base (21)..(21): 2'-deoxy-thymidine-5'-phosphate-phosphorothioate
uugacccgaunagnanauutt

SEQ ID NO: 431 - DNA, 21 bp, Artificial Sequence
  Description of Artificial Sequence: Synthetic oligonucleotide
  modified_base (1)..(1): 2'-O-methylcytidine-5'-phosphate
  modified_base (3)..(3): 2'-O-methyluridine-5'-phosphate
  modified_base (4)..(4): 2'-O-methylcytidine-5'-phosphate
  modified_base (5)..(6): 2'-O-methyluridine-5'-phosphate
  modified_base (8)..(8): 2'-O-methyluridine-5'-phosphate
  modified_base (10)..(10): 2'-O-methylcytidine-5'-phosphate
  modified_base (13)..(13): 2'-O-methyluridine-5'-phosphate
  modified_base (14)..(14): 2'-O-methylcytidine-5'-phosphate
  modified_base (16)..(18): 2'-O-methylcytidine-5'-phosphate
  modified_base (21)..(21): 2'-deoxy-thymidine-5'-phosphate-phosphorothioate
nannnnanangannannnatt

SEQ ID NO: 432 - DNA, 21 bp, Artificial Sequence
  Description of Artificial Sequence: Synthetic oligonucleotide
  modified_base (11)..(11): 2'-O-methyluridine-5'-phosphate
  modified_base (13)..(13): 2'-O-methyluridine-5'-phosphate
  modified_base (21)..(21): 2'-deoxy-thymidine-5'-phosphate-phosphorothioate
ugggugaucgnanaagaugtt

SEQ ID NO: 433 - DNA, 21 bp, Artificial Sequence
  Description of Artificial Sequence: Synthetic oligonucleotide
  modified_base (2)..(2): 2'-O-methyluridine-5'-phosphate
  modified_base (3)..(3): 2'-O-methylcytidine-5'-phosphate
  modified_base (4)..(5): 2'-O-methyluridine-5'-phosphate
  modified_base (7)..(7): 2'-O-methyluridine-5'-phosphate
  modified_base (9)..(9): 2'-O-methylcytidine-5'-phosphate
  modified_base (12)..(12): 2'-O-methyluridine-5'-phosphate
  modified_base (13)..(13): 2'-O-methylcytidine-5'-phosphate
  modified_base (15)..(17): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
annnnanangannannnantt

SEQ ID NO: 434 - DNA, 21 bp, Artificial Sequence
  Description of Artificial Sequence: Synthetic oligonucleotide
  modified_base (12)..(12): 2'-O-methyluridine-5'-phosphate
  modified_base (14)..(14): 2'-O-methyluridine-5'-phosphate
  modified_base (21)..(21): 2'-deoxy-thymidine-5'-phosphate-phosphorothioate
augggugaucgnanaagautt

SEQ ID NO: 435 - DNA, 21 bp, Artificial Sequence
  Description of Artificial Sequence: Synthetic oligonucleotide
  modified_base (2)..(6): 2'-O-methylcytidine-5'-phosphate
  modified_base (7)..(7): 2'-O-methyluridine-5'-phosphate
  modified_base (8)..(8): 2'-O-methylcytidine-5'-phosphate
  modified_base (10)..(11): 2'-O-methyluridine-5'-phosphate
  modified_base (16)..(16): 2'-O-methyluridine-5'-phosphate
  modified_base (21)..(21): 2'-deoxy-thymidine-5'-phosphate-phosphorothioate
annnnnnngnnagagngaatt

SEQ ID NO: 436 - DNA, 21 bp, Artificial Sequence
  Description of Artificial Sequence: Synthetic oligonucleotide
  modified_base (3)..(3): 2'-O-methylcytidine-5'-phosphate
  modified_base (8)..(8): 2'-O-methyluridine-5'-phosphate
  modified_base (21)..(21): 2'-deoxy-thymidine-5'-phosphate-phosphorothioate
uunacucnaacgagggggutt

SEQ ID NO: 437 - DNA, 21 bp, Artificial Sequence
  Description of Artificial Sequence: Synthetic oligonucleotide
  modified_base (2)..(2): 2'-O-methyluridine-5'-phosphate
  modified_base (3)..(3): 2'-O-methylcytidine-5'-phosphate
  modified_base (5)..(5): 2'-O-methyluridine-5'-phosphate
  modified_base (7)..(8): 2'-O-methylcytidine-5'-phosphateu
  modified_base (11)..(12): 2'-O-methyluridine-5'-phosphate
  modified_base (15)..(15): 2'-O-methyluridine-5'-phosphate
  modified_base (16)..(17): 2'-O-methylcytidine-5'-phosphate
  modified_base (21)..(21): 2'-deoxy-thymidine-5'-phosphate-phosphorothioate
anngngnnaanngannnagtt

SEQ ID NO: 438 - DNA, 21 bp, Artificial Sequence
  Description of Artificial Sequence: Synthetic oligonucleotide
  modified_base (7)..(7): 2'-O-methylcytidine-5'-phosphate
  modified_base (14)..(14): 2'-O-methylcytidine-5'-phosphate
  modified_base (21)..(21): 2'-deoxy-thymidine-5'-phosphate-phosphorothioate
cuggaunaauuggnacgautt

SEQ ID NO: 439 - DNA, 21 bp, Artificial Sequence
  Description of Artificial Sequence: Synthetic oligonucleotide
  modified_base (2)..(2): 2'-O-methyluridine-5'-phosphate
  modified_base (4)..(4): 2'-O-methyluridine-5'-phosphate
  modified_base (6)..(6): 2'-O-methylcytidine-5'-phosphate
  modified_base (7)..(7): 2'-O-methyluridine-5'-phosphate
  modified_base (10)..(10): 2'-O-methyluridine-5'-phosphate
  modified_base (11)..(11): 2'-O-methylcytidine-5'-phosphate
  modified_base (15)..(15): 2'-O-methyluridine-5'-phosphate
  modified_base (16)..(16): 2'-O-methylcytidine-5'-phosphate
  modified_base (21)..(21): 2'-deoxy-thymidine-5'-phosphate-phosphorothioate
angnannaanngggnnaagtt

SEQ ID NO: 440 - DNA, 21 bp, Artificial Sequence
  Description of Artificial Sequence: Synthetic oligonucleotide
  modified_base (12)..(12): 2'-O-methyluridine-5'-phosphate
  modified_base (15)..(15): 2'-O-methyluridine-5'-phosphate
  modified_base (17)..(17): 2'-O-methylcytidine-5'-phosphate
  modified_base (21)..(21): 2'-deoxy-thymidine-5'-phosphate-phosphorothioate
cuugacccgaunagnanautt

SEQ ID NO: 441 - DNA, 21 bp, Artificial Sequence
  Description of Artificial Sequence: Synthetic oligonucleotide
  modified_base (2)..(2): 2'-O-methyluridine-5'-phosphate
  modified_base (4)..(4): 2'-O-methylcytidine-5'-phosphate
  modified_base (5)..(5): 2'-O-methyluridine-5'-phosphate
  modified_base (8)..(8): 2'-O-methyluridine-5'-phosphate
  modified_base (9)..(9): 2'-O-methylcytidine-5'-phosphate
  modified_base (13)..(13): 2'-O-methyluridine-5'-phosphate
  modified_base (14)..(14): 2'-O-methylcytidine-5'-phosphate
  modified_base (21)..(21): 2'-deoxy-thymidine-5'-phosphate-phosphorothioate
gnannaanngggnnaaggatt

SEQ ID NO: 442 - DNA, 21 bp, Artificial Sequence
  Description of Artificial Sequence: Synthetic oligonucleotide
  modified_base (14)..(14): 2'-O-methyluridine-5'-phosphate
  modified_base (17)..(17): 2'-O-methyluridine-5'-phosphate
  modified_base (21)..(21): 2'-deoxy-thymidine-5'-phosphate-phosphorothioate
uccuugacccgaunagnactt

SEQ ID NO: 443 - DNA, 21 bp, Artificial Sequence
  Description of Artificial Sequence: Synthetic oligonucleotide
  modified_base (2)..(2): 2'-O-methyluridine-5'-phosphate
  modified_base (4)..(4): 2'-O-methylcytidine-5'-phosphate
  modified_base (6)..(6): 2'-O-methyluridine-5'-phosphate
  modified_base (10)..(10): 2'-O-methylcytidine-5'-phosphate
  modified_base (13)..(13): 2'-O-methyluridine-5'-phosphate
  modified_base (14)..(15): 2'-O-methylcytidine-5'-phosphate
  modified_base (17)..(17): 2'-O-methyluridine-5'-phosphate
  modified_base (19)..(19): 2'-O-methylcytidine-5'-phosphate
  modified_base (21)..(21): 2'-deoxy-thymidine-5'-phosphate-phosphorothioate
angnanaagngannnanantt

SEQ ID NO: 444 - DNA, 21 bp, Artificial Sequence
  Description of Artificial Sequence: Synthetic oligonucleotide
  modified_base (2)..(2): 2'-O-methyluridine-5'-phosphate
  modified_base (13)..(13): 2'-O-methyluridine-5'-phosphate
  modified_base (17)..(17): 2'-O-methylcytidine-5'-phosphate
  modified_base (21)..(21): 2'-deoxy-thymidine-5'-phosphate-phosphorothioate
gnauggaucgcunaugnautt

SEQ ID NO: 445 - DNA, 21 bp, Artificial Sequence
  Description of Artificial Sequence: Synthetic oligonucleotide
  modified_base (2)..(2): 2'-O-methylcytidine-5'-phosphate
  modified_base (8)..(8): 2'-O-methylcytidine-5'-phosphate
  modified_base (12)..(12): 2'-O-methyluridine-5'-phosphate
  modified_base (14)..(14): 2'-O-methylcytidine-5'-phosphate
  modified_base (15)..(16): 2'-O-methyluridine-5'-phosphate
  modified_base (18)..(19): 2'-O-methylcytidine-5'-phosphate
  modified_base (21)..(21): 2'-deoxy-thymidine-5'-phosphate-phosphorothioate
angggagngaangnnnanntt

SEQ ID NO: 446 - DNA, 21 bp, Artificial Sequence
  Description of Artificial Sequence: Synthetic oligonucleotide
  modified_base (3)..(3): 2'-O-methyluridine-5'-phosphate
  modified_base (7)..(7): 2'-O-methylcytidine-5'-phosphate
  modified_base (21)..(21): 2'-deoxy-thymidine-5'-phosphate-phosphorothioate
ggnaagnauucgcucccgutt

SEQ ID NO: 447 - DNA, 21 bp, Artificial Sequence
  Description of Artificial Sequence: Synthetic oligonucleotide
  modified_base (3)..(4): 2'-O-methyluridine-5'-phosphate
  modified_base (9)..(9): 2'-O-methyluridine-5'-phosphate
  modified_base (10)..(12): 2'-O-methylcytidine-5'-phosphate
  modified_base (13)..(13): 2'-O-methyluridine-5'-phosphate
  modified_base (15)..(15): 2'-O-methylcytidine-5'-phosphate
  modified_base (18)..(19): 2'-O-methyluridine-5'-phosphate
  modified_base (21)..(21): 2'-deoxy-thymidine-5'-phosphate-phosphorothioate
agnnagagnnnnnanggnntt

SEQ ID NO: 448 - DNA, 21 bp, Artificial Sequence
  Description of Artificial Sequence: Synthetic oligonucleotide
  modified_base (6)..(6): 2'-O-methyluridine-5'-phosphate
  modified_base (15)..(15): 2'-O-methyluridine-5'-phosphate
  modified_base (21)..(21): 2'-deoxy-thymidine-5'-phosphate-phosphorothioate
aaccgnagggacucnaacutt

SEQ ID NO: 449 - DNA, 21 bp, Artificial Sequence
  Description of Artificial Sequence: Synthetic oligonucleotide
  modified_base (1)..(1): 2'-O-methylcytidine-5'-phosphate
  modified_base (2)..(2): 2'-O-methyluridine-5'-phosphate
  modified_base (4)..(5): 2'-O-methylcytidine-5'-phosphate
  modified_base (7)..(7): 2'-O-methyluridine-5'-phosphate
  modified_base (10)..(10): 2'-O-methyluridine-5'-phosphate
  modified_base (13)..(13): 2'-O-methyluridine-5'-phosphate
  modified_base (14)..(14): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
nnanngnagnagnngaagntt

SEQ ID NO: 450 - DNA, 21 bp, Artificial Sequence
  Description of Artificial Sequence: Synthetic oligonucleotide
  modified_base (9)..(9): 2'-O-methyluridine-5'-phosphate
  modified_base (12)..(12): 2'-O-methyluridine-5'-phosphate
  modified_base (17)..(17): 2'-O-methyluridine-5'-phosphate
  modified_base (21)..(21): 2'-deoxy-thymidine-5'-phosphate-phosphorothioate
acuucgacnacnacggnagtt

SEQ ID NO: 451 - DNA, 21 bp, Artificial Sequence
  Description of Artificial Sequence: Synthetic oligonucleotide
  modified_base (4)..(5): 2'-O-methyluridine-5'-phosphate
  modified_base (6)..(6): 2'-O-methylcytidine-5'-phosphate
  modified_base (8)..(8): 2'-O-methylcytidine-5'-phosphate
  modified_base (10)..(10): 2'-O-methyluridine-5'-phosphate
  modified_base (12)..(13): 2'-O-methylcytidine-5'-phosphate
  modified_base (16)..(17): 2'-O-methylcytidine-5'-phosphate
  modified_base (21)..(21): 2'-deoxy-thymidine-5'-phosphate-phosphorothioate
gaannnangngnngannagtt

SEQ ID NO: 452 - DNA, 21 bp, Artificial Sequence
  Description of Artificial Sequence: Synthetic oligonucleotide
  modified_base (9)..(9): 2'-O-methylcytidine-5'-phosphate
  modified_base (21)..(21): 2'-deoxy-thymidine-5'-phosphate-phosphorothioate
cuggucggnacgugaauuctt

SEQ ID NO: 453 - DNA, 21 bp, Artificial Sequence
  Description of Artificial Sequence: Synthetic oligonucleotide
  modified_base (1)..(1): 2'-O-methyluridine-5'-phosphate
  modified_base (3)..(9): 2'-O-methylcytidine-5'-phosphate
  modified_base (13)..(13): 2'-O-methylcytidine-5'-phosphate
  modified_base (15)..(16): 2'-O-methyluridine-5'-phosphate
  modified_base (19)..(19): 2'-O-methyluridine-5'-phosphate
  modified_base (21)..(21): 2'-deoxy-thymidine-5'-phosphate-phosphorothioate
ngnnnnnnnaagngnnaantt

SEQ ID NO: 454 - DNA, 21 bp, Artificial Sequence
  Description of Artificial Sequence: Synthetic oligonucleotide
  modified_base (3)..(3): 2'-O-methyluridine-5'-phosphate
  modified_base (18)..(18): 2'-O-methylcytidine-5'-phosphate
  modified_base (21)..(21): 2'-deoxy-thymidine-5'-phosphate-phosphorothioate
aunaacgcuugggggggnatt

SEQ ID NO: 455 - DNA, 21 bp, Artificial Sequence
  Description of Artificial Sequence: Synthetic oligonucleotide
  modified_base (5)..(5): 2'-O-methyluridine-5'-phosphate
  modified_base (7)..(8): 2'-O-methyluridine-5'-phosphate
  modified_base (13)..(13): 2'-O-methyluridine-5'-phosphate
  modified_base (14)..(14): 2'-O-methylcytidine-5'-phosphate
  modified_base (16)..(17): 2'-O-methyluridine-5'-phosphate
  modified_base (19)..(19): 2'-O-methyluridine-5'-phosphate
  modified_base (21)..(21): 2'-deoxy-thymidine-5'-phosphate-phosphorothioate
agagngnnagganngnnantt

SEQ ID NO: 456 - DNA, 21 bp, Artificial Sequence
  Description of Artificial Sequence: Synthetic oligonucleotide
  modified_base (2)..(2): 2'-O-methyluridine-5'-phosphate
  modified_base (11)..(11): 2'-O-methyluridine-5'-phosphate
  modified_base (14)..(14): 2'-O-methylcytidine-5'-phosphate
  modified_base (21)..(21): 2'-deoxy-thymidine-5'-phosphate-phosphorothioate
anaacgauccnaanacucutt

SEQ ID NO: 457 - DNA, 21 bp, Artificial Sequence
  Description of Artificial Sequence: Synthetic oligonucleotide
  modified_base (3)..(3): 2'-O-methyluridine-5'-phosphate
  modified_base (4)..(6): 2'-O-methylcytidine-5'-phosphate
  modified_base (11)..(11): 2'-O-methylcytidine-5'-phosphate
  modified_base (14)..(14): 2'-O-methylcytidine-5'-phosphate
  modified_base (17)..(18): 2'-O-methyluridine-5'-phosphate
  modified_base (19)..(19): 2'-O-methylcytidine-5'-phosphate
  modified_base (21)..(21): 2'-deoxy-thymidine-5'-phosphate-phosphorothioate
aannnngaggnggnaannntt

SEQ ID NO: 458 - DNA, 21 bp, Artificial Sequence
  Description of Artificial Sequence: Synthetic oligonucleotide
  modified_base (4)..(5): 2'-O-methyluridine-5'-phosphate
  modified_base (18)..(18): 2'-O-methyluridine-5'-phosphate
  modified_base (21)..(21): 2'-deoxy-thymidine-5'-phosphate-phosphorothioate
gaanngccgccucggganutt

SEQ ID NO: 459 - DNA, 21 bp, Artificial Sequence
  Description of Artificial Sequence: Synthetic oligonucleotide
  modified_base (1)..(1): 2'-O-methylcytidine-5'-phosphate
  modified_base (3)..(3): 2'-O-methylcytidine-5'-phosphate
  modified_base (7)..(8): 2'-O-methyluridine-5'-phosphate
  modified_base (13)..(13): 2'-O-methyluridine-5'-phosphate
  modified_base (14)..(16): 2'-O-methylcytidine-5'-phosphate
  modified_base (17)..(17): 2'-O-methyluridine-5'-phosphate
  modified_base (19)..(19): 2'-O-methylcytidine-5'-phosphate
  modified_base (21)..(21): 2'-deoxy-thymidine-5'-phosphate-phosphorothioate
ngnaagnnagagnnnnnantt

SEQ ID NO: 460 - DNA, 21 bp, Artificial Sequence
  Description of Artificial Sequence: Synthetic oligonucleotide
  modified_base (2)..(2): 2'-O-methyluridine-5'-phosphate
  modified_base (11)..(11): 2'-O-methyluridine-5'-phosphate
  modified_base (21)..(21): 2'-deoxy-thymidine-5'-phosphate-phosphorothioate
gnagggacucnaacuugcgtt

SEQ ID NO: 461 - DNA, 21 bp, Artificial Sequence
  Description of Artificial Sequence: Synthetic oligonucleotide
  modified_base (1)..(1): 2'-O-methyluridine-5'-phosphate
  modified_base (4)..(5): 2'-O-methyluridine-5'-phosphate
  modified_base (6)..(6): 2'-O-methylcytidine-5'-phosphate
  modified_base (8)..(8): 2'-O-methyluridine-5'-phosphate
  modified_base (9)..(9): 2'-O-methylcytidine-5'-phosphate
  modified_base (11)..(11): 2'-O-methylcytidine-5'-phosphate
  modified_base (12)..(13): 2'-O-methyluridine-5'-phosphate
  modified_base (16)..(16): 2'-O-methyluridine-5'-phosphate
  modified_base (18)..(18): 2'-O-methyluridine-5'-phosphate
  modified_base (21)..(21): 2'-deoxy-thymidine-5'-phosphate-phosphorothioate
ngannnanngnnnaananatt

SEQ ID NO: 462 - DNA, 21 bp, Artificial Sequence
  Description of Artificial Sequence: Synthetic oligonucleotide
  modified_base (1)..(1): 2'-O-methyluridine-5'-phosphate
  modified_base (3)..(3): 2'-O-methyluridine-5'-phosphate
  modified_base (6)..(6): 2'-O-methyluridine-5'-phosphate
  modified_base (18)..(18): 2'-O-methylcytidine-5'-phosphate
  modified_base (21)..(21): 2'-deoxy-thymidine-5'-phosphate-phosphorothioate
nanaunaagcgaugaaunatt

SEQ ID NO: 463 - DNA, 21 bp, Artificial Sequence
  Description of Artificial Sequence: Synthetic oligonucleotide
  modified_base (4)..(5): 2'-O-methylcytidine-5'-phosphate
  modified_base (6)..(6): 2'-O-methyluridine-5'-phosphate
  modified_base (11)..(11): 2'-O-methylcytidine-5'-phosphate
  modified_base (12)..(12): 2'-O-methyluridine-5'-phosphate
  modified_base (15)..(15): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
agannnaagannagnaaantt

SEQ ID NO: 464 - DNA, 21 bp, Artificial Sequence
  Description of Artificial Sequence: Synthetic oligonucleotide
  modified_base (7)..(7): 2'-O-methyluridine-5'-phosphate
  modified_base (13)..(13): 2'-O-methyluridine-5'-phosphate
  modified_base (21)..(21): 2'-deoxy-thymidine-5'-phosphate-phosphorothioate
auuugcnagucunaggucutt

SEQ ID NO: 465 - DNA, 21 bp, Artificial Sequence
  Description of Artificial Sequence: Synthetic oligonucleotide
  modified_base (2)..(3): 2'-O-methyluridine-5'-phosphate
  modified_base (5)..(5): 2'-O-methylcytidine-5'-phosphate
  modified_base (6)..(6): 2'-O-methyluridine-5'-phosphate
  modified_base (9)..(9): 2'-O-methyluridine-5'-phosphate
  modified_base (10)..(10): 2'-O-methylcytidine-5'-phosphate
  modified_base (15)..(15): 2'-O-methylcytidine-5'-phosphate
  modified_base (16)..(16): 2'-O-methyluridine-5'-phosphate
  modified_base (18)..(18): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
annannagnngaganngnntt

SEQ ID NO: 466 - DNA, 21 bp, Artificial Sequence
  Description of Artificial Sequence: Synthetic oligonucleotide
  modified_base (3)..(3): 2'-O-methylcytidine-5'-phosphate
  modified_base (13)..(13): 2'-O-methyluridine-5'-phosphate
  modified_base (16)..(16): 2'-O-methyluridine-5'-phosphate
  modified_base (21)..(21): 2'-deoxy-thymidine-5'-phosphate-phosphorothioate
agnagucucgacnagnaautt

SEQ ID NO: 467 - DNA, 21 bp, Artificial Sequence
  Description of Artificial Sequence: Synthetic oligonucleotide
  modified_base (1)..(1): 2'-O-methyluridine-5'-phosphate
  modified_base (2)..(2): 2'-O-methylcytidine-5'-phosphate
  modified_base (6)..(7): 2'-O-methylcytidine-5'-phosphate
  modified_base (8)..(8): 2'-O-methyluridine-5'-phosphate
  modified_base (10)..(10): 2'-O-methylcytidine-5'-phosphate
  modified_base (12)..(12): 2'-O-methylcytidine-5'-phosphate
  modified_base (13)..(14): 2'-O-methyluridine-5'-phosphate
  modified_base (16)..(16): 2'-O-methylcytidine-5'-phosphate
  modified_base (17)..(18): 2'-O-methyluridine-5'-phosphate
  modified_base (21)..(21): 2'-deoxy-thymidine-5'-phosphate-phosphorothioate
nnaggnnnangnnnannngtt

SEQ ID NO: 468 - DNA, 21 bp, Artificial Sequence
  Description of Artificial Sequence: Synthetic oligonucleotide
  modified_base (1)..(1): 2'-O-methylcytidine-5'-phosphate
  modified_base (5)..(5): 2'-O-methyluridine-5'-phosphate
  modified_base (11)..(11): 2'-O-methyluridine-5'-phosphate
  modified_base (21)..(21): 2'-deoxy-thymidine-5'-phosphate-phosphorothioate
naagnaagcgnaggccugatt

SEQ ID NO: 469 - DNA, 21 bp, Artificial Sequence
  Description of Artificial Sequence: Synthetic oligonucleotide
  modified_base (1)..(5): 2'-O-methylcytidine-5'-phosphate
  modified_base (9)..(9): 2'-O-methylcytidine-5'-phosphate
  modified_base (11)..(12): 2'-O-methyluridine-5'-phosphate
  modified_base (15)..(15): 2'-O-methyluridine-5'-phosphate
  modified_base (21)..(21): 2'-deoxy-thymidine-5'-phosphate-phosphorothioate
nnnnnaagngnnaangaagtt

SEQ ID NO: 470 - DNA, 21 bp, Artificial Sequence
  Description of Artificial Sequence: Synthetic oligonucleotide
  modified_base (4)..(4): 2'-O-methylcytidine-5'-phosphate
  modified_base (7)..(7): 2'-O-methyluridine-5'-phosphate
  modified_base (21)..(21): 2'-deoxy-thymidine-5'-phosphate-phosphorothioate
cuunaunaacgcuugggggtt

SEQ ID NO: 471 - DNA, 21 bp, Artificial Sequence
  Description of Artificial Sequence: Synthetic oligonucleotide
  modified_base (2)..(3): 2'-O-methyluridine-5'-phosphate
  modified_base (5)..(5): 2'-O-methyluridine-5'-phosphate
  modified_base (7)..(7): 2'-O-methylcytidine-5'-phosphate
  modified_base (11)..(11): 2'-O-methyluridine-5'-phosphate
  modified_base (12)..(13): 2'-O-methylcytidine-5'-phosphate
  modified_base (15)..(16): 2'-O-methyluridine-5'-phosphate
  modified_base (19)..(19): 2'-O-methyluridine-5'-phosphate
  modified_base (21)..(21): 2'-deoxy-thymidine-5'-phosphate-phosphorothioate
annanangggnnnannaantt

SEQ ID NO: 472 - DNA, 21 bp, Artificial Sequence
  Description of Artificial Sequence: Synthetic oligonucleotide
  modified_base (3)..(3): 2'-O-methyluridine-5'-phosphate
  modified_base (14)..(14): 2'-O-methyluridine-5'-phosphate
  modified_base (16)..(16): 2'-O-methyluridine-5'-phosphate
  modified_base (21)..(21): 2'-deoxy-thymidine-5'-phosphate-phosphorothioate
aunaauggacccgnanaautt

SEQ ID NO: 473 - DNA, 21 bp, Artificial Sequence
  Description of Artificial Sequence: Synthetic oligonucleotide
  modified_base (1)..(1): 2'-O-methylcytidine-5'-phosphate
  modified_base (2)..(2): 2'-O-methyluridine-5'-phosphate
  modified_base (3)..(3): 2'-O-methylcytidine-5'-phosphate
  modified_base (6)..(6): 2'-O-methylcytidine-5'-phosphate
  modified_base (10)..(10): 2'-O-methyluridine-5'-phosphate
  modified_base (17)..(18): 2'-O-methylcytidine-5'-phosphate
  modified_base (21)..(21): 2'-deoxy-thymidine-5'-phosphate-phosphorothioate
nnnaangagnaaaggannatt

SEQ ID NO: 474 - DNA, 21 bp, Artificial Sequence
  Description of Artificial Sequence: Synthetic oligonucleotide
  modified_base (9)..(9): 2'-O-methyluridine-5'-phosphate
  modified_base (21)..(21): 2'-deoxy-thymidine-5'-phosphate-phosphorothioate
ugguccuunacucguugagtt

SEQ ID NO: 475 - DNA, 21 bp, Artificial Sequence
  Description of Artificial Sequence: Synthetic oligonucleotide
  modified_base (1)..(2): 2'-O-methyluridine-5'-phosphate
  modified_base (4)..(4): 2'-O-methyluridine-5'-phosphate
  modified_base (6)..(6): 2'-O-methylcytidine-5'-phosphate
  modified_base (9)..(9): 2'-O-methyluridine-5'-phosphate
  modified_base (14)..(14): 2'-O-methylcytidine-5'-phosphate
  modified_base (15)..(15): 2'-O-methyluridine-5'-phosphate
  modified_base (18)..(18): 2'-O-methylcytidine-5'-phosphate
  modified_base (21)..(21): 2'-deoxy-thymidine-5'-phosphate-phosphorothioate
nngnanganagggnnaanatt

SEQ ID NO: 476 - DNA, 21 bp, Artificial Sequence
  Description of Artificial Sequence: Synthetic oligonucleotide
  modified_base (4)..(4): 2'-O-methyluridine-5'-phosphate
  modified_base (10)..(10): 2'-O-methyluridine-5'-phosphate
  modified_base (15)..(15): 2'-O-methyluridine-5'-phosphate
  modified_base (17)..(17): 2'-O-methylcytidine-5'-phosphate
  modified_base (21)..(21): 2'-deoxy-thymidine-5'-phosphate-phosphorothioate
ugunagcccnaucgnanaatt

SEQ ID NO: 477 - DNA, 21 bp, Artificial Sequence
  Description of Artificial Sequence: Synthetic oligonucleotide
  modified_base (2)..(3): 2'-O-methyluridine-5'-phosphate
  modified_base (5)..(5): 2'-O-methyluridine-5'-phosphate
  modified_base (7)..(9): 2'-O-methyluridine-5'-phosphate
  modified_base (12)..(12): 2'-O-methylcytidine-5'-phosphate
  modified_base (15)..(16): 2'-O-methylcytidine-5'-phosphate
  modified_base (17)..(17): 2'-O-methyluridine-5'-phosphate
  modified_base (19)..(19): 2'-O-methyluridine-5'-phosphate
  modified_base (21)..(21): 2'-deoxy-thymidine-5'-phosphate-phosphorothioate
gnngngnnnagngannnantt

SEQ ID NO: 478 - DNA, 21 bp, Artificial Sequence
  Description of Artificial Sequence: Synthetic oligonucleotide
  modified_base (2)..(2): 2'-O-methyluridine-5'-phosphate
  modified_base (10)..(10): 2'-O-methyluridine-5'-phosphate
  modified_base (14)..(14): 2'-O-methylcytidine-5'-phosphate
  modified_base (16)..(16): 2'-O-methylcytidine-5'-phosphate
  modified_base (21)..(21): 2'-deoxy-thymidine-5'-phosphate-phosphorothioate
anaggucgcnaaananaactt

SEQ ID NO: 479 - DNA, 21 bp, Artificial Sequence
  Description of Artificial Sequence: Synthetic oligonucleotide
  modified_base (4)..(4): 2'-O-methylcytidine-5'-phosphate
  modified_base (5)..(5): 2'-O-methyluridine-5'-phosphate
  modified_base (8)..(8): 2'-O-methyluridine-5'-phosphate
  modified_base (10)..(10): 2'-O-methyluridine-5'-phosphate
  modified_base (14)..(15): 2'-O-methyluridine-5'-phosphate
  modified_base (17)..(17): 2'-O-methyluridine-5'-phosphate
  modified_base (18)..(18): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
ggannaanangggnnannntt

SEQ ID NO: 480 - DNA, 21 bp, Artificial Sequence
  Description of Artificial Sequence: Synthetic oligonucleotide
  modified_base (4)..(4): 2'-O-methyluridine-5'-phosphate
  modified_base (9)..(9): 2'-O-methylcytidine-5'-phosphate
  modified_base (11)..(11): 2'-O-methyluridine-5'-phosphate
  modified_base (14)..(14): 2'-O-methyluridine-5'-phosphate
  modified_base (21)..(21): 2'-deoxy-thymidine-5'-phosphate-phosphorothioate
aganaaccnanaunagucctt

SEQ ID NO: 481 - DNA, 21 bp, Artificial Sequence
  Description of Artificial Sequence: Synthetic oligonucleotide
  modified_base (1)..(1): 2'-O-methylcytidine-5'-phosphate
  modified_base (2)..(2): 2'-O-methyluridine-5'-phosphate
  modified_base (4)..(4): 2'-O-methylcytidine-5'-phosphate
  modified_base (7)..(7): 2'-O-methyluridine-5'-phosphate
  modified_base (11)..(11): 2'-O-methyluridine-5'-phosphate
  modified_base (13)..(13): 2'-O-methyluridine-5'-phosphate
  modified_base (15)..(15): 2'-O-methylcytidine-5'-phosphate
  modified_base (18)..(18): 2'-O-methylcytidine-5'-phosphate
  modified_base (21)..(21): 2'-deoxy-thymidine-5'-phosphate-phosphorothioate
nngngangganananganatt

SEQ ID NO: 482 - DNA, 21 bp, Artificial Sequence
  Description of Artificial Sequence: Synthetic oligonucleotide
  modified_base (6)..(6): 2'-O-methyluridine-5'-phosphate
  modified_base (8)..(8): 2'-O-methyluridine-5'-phosphate
  modified_base (12)..(12): 2'-O-methylcytidine-5'-phosphate
  modified_base (17)..(17): 2'-O-methylcytidine-5'-phosphate
  modified_base (21)..(21): 2'-deoxy-thymidine-5'-phosphate-phosphorothioate
ugucgnanaucnaucgnagtt

SEQ ID NO: 483 - DNA, 21 bp, Artificial Sequence
  Description of Artificial Sequence: Synthetic oligonucleotide
  modified_base (3)..(4): 2'-O-methyluridine-5'-phosphate
  modified_base (6)..(6): 2'-O-methyluridine-5'-phosphate
  modified_base (8)..(10): 2'-O-methyluridine-5'-phosphate
  modified_base (13)..(13): 2'-O-methylcytidine-5'-phosphate
  modified_base (16)..(17): 2'-O-methylcytidine-5'-phosphate
  modified_base (18)..(18): 2'-O-methyluridine-5'-phosphate
  modified_base (21)..(21): 2'-deoxy-thymidine-5'-phosphate-phosphorothioate
agnngngnnnagngannnatt

SEQ ID NO: 484 - DNA, 21 bp, Artificial Sequence
  Description of Artificial Sequence: Synthetic oligonucleotide
  modified_base (1)..(1): 2'-O-methyluridine-5'-phosphate
  modified_base (9)..(9): 2'-O-methyluridine-5'-phosphate
  modified_base (13)..(13): 2'-O-methylcytidine-5'-phosphate
  modified_base (15)..(15): 2'-O-methylcytidine-5'-phosphate
  modified_base (21)..(21): 2'-deoxy-thymidine-5'-phosphate-phosphorothioate
naggucgcnaaananaacutt

SEQ ID NO: 485 - DNA, 21 bp, Artificial Sequence
  Description of Artificial Sequence: Synthetic oligonucleotide
  modified_base (1)..(2): 2'-O-methyluridine-5'-phosphate
  modified_base (6)..(6): 2'-O-methylcytidine-5'-phosphate
  modified_base (7)..(7): 2'-O-methyluridine-5'-phosphate
  modified_base (10)..(10): 2'-O-methyluridine-5'-phosphate
  modified_base (11)..(11): 2'-O-methylcytidine-5'-phosphate
  modified_base (12)..(12): 2'-O-methyluridine-5'-phosphate
  modified_base (14)..(14): 2'-O-methylcytidine-5'-phosphate
  modified_base (15)..(15): 2'-O-methyluridine-5'-phosphate
  modified_base (16)..(16): 2'-O-methylcytidine-5'-phosphate
  modified_base (18)..(18): 2'-O-methylcytidine-5'-phosphate
  modified_base (21)..(21): 2'-deoxy-thymidine-5'-phosphate-phosphorothioate
nngaannagnnnannngnatt

SEQ ID NO: 486 - DNA, 21 bp, Artificial Sequence
  Description of Artificial Sequence: Synthetic oligonucleotide
  modified_base (7)..(7): 2'-O-methyluridine-5'-phosphate
  modified_base (12)..(12): 2'-O-methyluridine-5'-phosphate
  modified_base (17)..(17): 2'-O-methylcytidine-5'-phosphate
  modified_base (21)..(21): 2'-deoxy-thymidine-5'-phosphate-phosphorothioate
ugcgagnagacnaguunaatt

SEQ ID NO: 487 - DNA, 21 bp, Artificial Sequence
  Description of Artificial Sequence: Synthetic oligonucleotide
  modified_base (4)..(4): 2'-O-methyluridine-5'-phosphate
  modified_base (5)..(6): 2'-O-methylcytidine-5'-phosphate
  modified_base (7)..(7): 2'-O-methyluridine-5'-phosphate
  modified_base (9)..(10): 2'-O-methylcytidine-5'-phosphate
  modified_base (16)..(16): 2'-O-methyluridine-5'-phosphate
  modified_base (21)..(21): 2'-deoxy-thymidine-5'-phosphate-phosphorothioate
gaannnnanngggaanagatt

SEQ ID NO: 488 - DNA, 21 bp, Artificial Sequence
  Description of Artificial Sequence: Synthetic oligonucleotide
  modified_base (3)..(3): 2'-O-methyluridine-5'-phosphate
  modified_base (12)..(12): 2'-O-methyluridine-5'-phosphate
  modified_base (21)..(21): 2'-deoxy-thymidine-5'-phosphate-phosphorothioate
ucnauucccggnaggauuctt

SEQ ID NO: 489 - DNA, 21 bp, Artificial Sequence
  Description of Artificial Sequence: Synthetic oligonucleotide
  modified_base (1)..(1): 2'-O-methyluridine-5'-phosphate
  modified_base (3)..(4): 2'-O-methyluridine-5'-phosphate
  modified_base (6)..(6): 2'-O-methyluridine-5'-phosphate
  modified_base (8)..(8): 2'-O-methylcytidine-5'-phosphate
  modified_base (12)..(12): 2'-O-methyluridine-5'-phosphate
  modified_base (13)..(14): 2'-O-methylcytidine-5'-phosphate
  modified_base (16)..(17): 2'-O-methyluridine-5'-phosphate
  modified_base (21)..(21): 2'-deoxy-thymidine-5'-phosphate-phosphorothioate
nannanangggnnnannaatt

SEQ ID NO: 490 - DNA, 21 bp, Artificial Sequence
  Description of Artificial Sequence: Synthetic oligonucleotide
  modified_base (2)..(2): 2'-O-methyluridine-5'-phosphate
  modified_base (13)..(13): 2'-O-methyluridine-5'-phosphate
  modified_base (15)..(15): 2'-O-methyluridine-5'-phosphate
  modified_base (18)..(18): 2'-O-methyluridine-5'-phosphate
  modified_base (21)..(21): 2'-deoxy-thymidine-5'-phosphate-phosphorothioate
unaauggacccgnanaanatt

SEQ ID NO: 491 - DNA, 21 bp, Artificial Sequence
  Description of Artificial Sequence: Synthetic oligonucleotide
  modified_base (1)..(1): 2'-O-methyluridine-5'-phosphate
  modified_base (3)..(3): 2'-O-methyluridine-5'-phosphate
  modified_base (5)..(5): 2'-O-methylcytidine-5'-phosphate
  modified_base (9)..(9): 2'-O-methyluridine-5'-phosphate
  modified_base (10)..(11): 2'-O-methylcytidine-5'-phosphate
  modified_base (13)..(14): 2'-O-methyluridine-5'-phosphate
  modified_base (17)..(19): 2'-O-methyluridine-5'-phosphate
  modified_base (21)..(21): 2'-deoxy-thymidine-5'-phosphate-phosphorothioate
nanangggnnnannaannntt

SEQ ID NO: 492 - DNA, 21 bp, Artificial Sequence
  Description of Artificial Sequence: Synthetic oligonucleotide
  modified_base (5)..(5): 2'-O-methyluridine-5'-phosphate
  modified_base (16)..(16): 2'-O-methyluridine-5'-phosphate
  modified_base (18)..(18): 2'-O-methyluridine-5'-phosphate
  modified_base (21)..(21): 2'-deoxy-thymidine-5'-phosphate-phosphorothioate
aaaunaauggacccgnanatt

SEQ ID NO: 493 - DNA, 21 bp, Artificial Sequence
  Description of Artificial Sequence: Synthetic oligonucleotide
  modified_base (1)..(1): 2'-O-methyluridine-5'-phosphate
  modified_base (3)..(3): 2'-O-methylcytidine-5'-phosphate
  modified_base (5)..(5): 2'-O-methyluridine-5'-phosphate
  modified_base (9)..(9): 2'-O-methyluridine-5'-phosphate
  modified_base (10)..(10): 2'-O-methylcytidine-5'-phosphate
  modified_base (13)..(13): 2'-O-methylcytidine-5'-phosphate
  modified_base (15)..(15): 2'-O-methylcytidine-5'-phosphate
  modified_base (16)..(17): 2'-O-methyluridine-5'-phosphate
  modified_base (21)..(21): 2'-deoxy-thymidine-5'-phosphate-phosphorothioate
nanangaannganannnaatt

SEQ ID NO: 494 - DNA, 21 bp, Artificial Sequence
  Description of Artificial Sequence: Synthetic oligonucleotide
  modified_base (2)..(2): 2'-O-methyluridine-5'-phosphate
  modified_base (14)..(14): 2'-O-methylcytidine-5'-phosphate
  modified_base (18)..(18): 2'-O-methyluridine-5'-phosphate
  modified_base (21)..(21): 2'-deoxy-thymidine-5'-phosphate-phosphorothioate
unaagugucgauunaugnatt

SEQ ID NO: 495 - DNA, 21 bp, Artificial Sequence
  Description of Artificial Sequence: Synthetic oligonucleotide
  modified_base (5)..(6): 2'-O-methyluridine-5'-phosphate
  modified_base (8)..(8): 2'-O-methyluridine-5'-phosphate
  modified_base (10)..(10): 2'-O-methylcytidine-5'-phosphate
  modified_base (13)..(13): 2'-O-methyluridine-5'-phosphate
  modified_base (18)..(18): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
aaaanngnanganagggnntt

SEQ ID NO: 496 - DNA, 21 bp, Artificial Sequence
  Description of Artificial Sequence: Synthetic oligonucleotide
  modified_base (6)..(6): 2'-O-methyluridine-5'-phosphate
  modified_base (11)..(11): 2'-O-methyluridine-5'-phosphate
  modified_base (13)..(13): 2'-O-methylcytidine-5'-phosphate
  modified_base (21)..(21): 2'-deoxy-thymidine-5'-phosphate-phosphorothioate
agcccnaucgnanaauuuutt

SEQ ID NO: 497 - DNA, 21 bp, Artificial Sequence
  Description of Artificial Sequence: Synthetic oligonucleotide
  modified_base (2)..(2): 2'-O-methyluridine-5'-phosphate
  modified_base (4)..(4): 2'-O-methylcytidine-5'-phosphate
  modified_base (7)..(7): 2'-O-methyluridine-5'-phosphate
  modified_base (12)..(12): 2'-O-methylcytidine-5'-phosphate
  modified_base (13)..(13): 2'-O-methyluridine-5'-phosphate
  modified_base (16)..(16): 2'-O-methylcytidine-5'-phosphate
  modified_base (18)..(19): 2'-O-methyluridine-5'-phosphate
  modified_base (21)..(21): 2'-deoxy-thymidine-5'-phosphate-phosphorothioate
gnanganagggnnaananntt

SEQ ID NO: 498 - DNA, 21 bp, Artificial Sequence
  Description of Artificial Sequence: Synthetic oligonucleotide
  modified_base (6)..(6): 2'-O-methyluridine-5'-phosphate
  modified_base (12)..(12): 2'-O-methyluridine-5'-phosphate
  modified_base (17)..(17): 2'-O-methyluridine-5'-phosphate
  modified_base (21)..(21): 2'-deoxy-thymidine-5'-phosphate-phosphorothioate
aaugunagcccnaucgnactt

SEQ ID NO: 499 - DNA, 21 bp, Artificial Sequence
  Description of Artificial Sequence: Synthetic oligonucleotide
  modified_base (4)..(6): 2'-O-methylcytidine-5'-phosphate
  modified_base (10)..(11): 2'-O-methyluridine-5'-phosphate
  modified_base (14)..(14): 2'-O-methylcytidine-5'-phosphate
  modified_base (16)..(16): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
gagnnnaaannaananggntt

SEQ ID NO: 500 - DNA, 21 bp, Artificial Sequence
  Description of Artificial Sequence: Synthetic oligonucleotide
  modified_base (8)..(8): 2'-O-methyluridine-5'-phosphate
  modified_base (21)..(21): 2'-deoxy-thymidine-5'-phosphate-phosphorothioate
accgugunaauuugggcuctt

SEQ ID NO: 501 - DNA, 21 bp, Artificial Sequence
  Description of Artificial Sequence: Synthetic oligonucleotide
  modified_base (1)..(3): 2'-O-methylcytidine-5'-phosphate
  modified_base (5)..(5): 2'-O-methylcytidine-5'-phosphate
  modified_base (6)..(6): 2'-O-methyluridine-5'-phosphate
  modified_base (8)..(9): 2'-O-methyluridine-5'-phosphate
  modified_base (13)..(14): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
nnngnnannaagnngaggntt

SEQ ID NO: 502 - DNA, 21 bp, Artificial Sequence
  Description of Artificial Sequence: Synthetic oligonucleotide
  modified_base (10)..(10): 2'-O-methyluridine-5'-phosphate
  modified_base (13)..(13): 2'-O-methyluridine-5'-phosphate
  modified_base (21)..(21): 2'-deoxy-thymidine-5'-phosphate-phosphorothioate
accucggcunaanagcgggtt

SEQ ID NO: 503 - DNA, 21 bp, Artificial Sequence
  Description of Artificial Sequence: Synthetic oligonucleotide
  modified_base (2)..(4): 2'-O-methylcytidine-5'-phosphate
  modified_base (6)..(6): 2'-O-methylcytidine-5'-phosphate
  modified_base (7)..(7): 2'-O-methyluridine-5'-phosphate
  modified_base (9)..(10): 2'-O-methyluridine-5'-phosphate
  modified_base (14)..(15): 2'-O-methylcytidine-5'-phosphate
  modified_base (21)..(21): 2'-deoxy-thymidine-5'-phosphate-phosphorothioate
gnnngnnannaagnngaggtt

SEQ ID NO: 504 - DNA, 21 bp, Artificial Sequence
  Description of Artificial Sequence: Synthetic oligonucleotide
  modified_base (9)..(9): 2'-O-methyluridine-5'-phosphate
  modified_base (12)..(12): 2'-O-methyluridine-5'-phosphate
  modified_base (21)..(21): 2'-deoxy-thymidine-5'-phosphate-phosphorothioate
ccucggcunaanagcgggctt

SEQ ID NO: 505 - DNA, 21 bp, Artificial Sequence
  Description of Artificial Sequence: Synthetic oligonucleotide
  modified_base (3)..(4): 2'-O-methyluridine-5'-phosphate
  modified_base (6)..(6): 2'-O-methyluridine-5'-phosphate
  modified_base (9)..(9): 2'-O-methylcytidine-5'-phosphate
  modified_base (11)..(11): 2'-O-methylcytidine-5'-phosphate
  modified_base (14)..(15): 2'-O-methyluridine-5'-phosphate
  modified_base (18)..(18): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
aanngnagngnaannganntt

SEQ ID NO: 506 - DNA, 21 bp, Artificial Sequence
  Description of Artificial Sequence: Synthetic oligonucleotide
  modified_base (4)..(4): 2'-O-methylcytidine-5'-phosphate
  modified_base (13)..(13): 2'-O-methyluridine-5'-phosphate
  modified_base (15)..(15): 2'-O-methylcytidine-5'-phosphate
  modified_base (21)..(21): 2'-deoxy-thymidine-5'-phosphate-phosphorothioate
agunaauugcgcnanaauutt

SEQ ID NO: 507 - DNA, 21 bp, Artificial Sequence
  Description of Artificial Sequence: Synthetic oligonucleotide
  modified_base (3)..(3): 2'-O-methylcytidine-5'-phosphate
  modified_base (6)..(6): 2'-O-methyluridine-5'-phosphate
  modified_base (7)..(7): 2'-O-methylcytidine-5'-phosphate
  modified_base (10)..(10): 2'-O-methyluridine-5'-phosphate
  modified_base (11)..(11): 2'-O-methylcytidine-5'-phosphate
  modified_base (12)..(12): 2'-O-methyluridine-5'-phosphate
  modified_base (13)..(14): 2'-O-methylcytidine-5'-phosphate
  modified_base (19)..(19): 2'-O-methylcytidine-5'-phosphate
  modified_base (21)..(21): 2'-deoxy-thymidine-5'-phosphate-phosphorothioate
agngannaannnnngaaantt

SEQ ID NO: 508 - DNA, 21 bp, Artificial Sequence
  Description of Artificial Sequence: Synthetic oligonucleotide
  modified_base (2)..(3): 2'-O-methyluridine-5'-phosphate
  modified_base (11)..(12): 2'-O-methyluridine-5'-phosphate
  modified_base (21)..(21): 2'-deoxy-thymidine-5'-phosphate-phosphorothioate
gnnucggaganngaucgcutt

SEQ ID NO: 509 - DNA, 21 bp, Artificial Sequence
  Description of Artificial Sequence: Synthetic oligonucleotide
  modified_base (1)..(2): 2'-O-methyluridine-5'-phosphate
  modified_base (6)..(6): 2'-O-methylcytidine-5'-phosphate
  modified_base (9)..(9): 2'-O-methyluridine-5'-phosphate
  modified_base (10)..(10): 2'-O-methylcytidine-5'-phosphate
  modified_base (13)..(13): 2'-O-methyluridine-5'-phosphate
  modified_base (14)..(14): 2'-O-methylcytidine-5'-phosphate
  modified_base (15)..(15): 2'-O-methyluridine-5'-phosphate
  modified_base (16)..(17): 2'-O-methylcytidine-5'-phosphate
  modified_base (21)..(21): 2'-deoxy-thymidine-5'-phosphate-phosphorothioate
nngagngannaannnnngatt

SEQ ID NO: 510 - DNA, 21 bp, Artificial Sequence
  Description of Artificial Sequence: Synthetic oligonucleotide
  modified_base (17)..(17): 2'-O-methylcytidine-5'-phosphate
  modified_base (21)..(21): 2'-deoxy-thymidine-5'-phosphate-phosphorothioate
ucggagauugaucgcunaatt

SEQ ID NO: 511 - DNA, 21 bp, Artificial Sequence
  Description of Artificial Sequence: Synthetic oligonucleotide
  modified_base (1)..(2): 2'-O-methyluridine-5'-phosphate
  modified_base (3)..(3): 2'-O-methylcytidine-5'-phosphate
  modified_base (7)..(7): 2'-O-methyluridine-5'-phosphate
  modified_base (8)..(8): 2'-O-methylcytidine-5'-phosphate
  modified_base (9)..(10): 2'-O-methyluridine-5'-phosphate
  modified_base (11)..(11): 2'-O-methylcytidine-5'-phosphate
  modified_base (15)..(16): 2'-O-methylcytidine-5'-phosphate
  modified_base (19)..(19): 2'-O-methylcytidine-5'-phosphate
  modified_base (21)..(21): 2'-deoxy-thymidine-5'-phosphate-phosphorothioate
nnngaannnnnaaanngantt

SEQ ID NO: 512 - DNA, 21 bp, Artificial Sequence
  Description of Artificial Sequence: Synthetic oligonucleotide
  modified_base (6)..(8): 2'-O-methyluridine-5'-phosphate
  modified_base (14)..(14): 2'-O-methyluridine-5'-phosphate
  modified_base (21)..(21): 2'-deoxy-thymidine-5'-phosphate-phosphorothioate
gucggnnngaaganucgaatt

SEQ ID NO: 513 - DNA, 21 bp, Artificial Sequence
  Description of Artificial Sequence: Synthetic oligonucleotide
  modified_base (1)..(1): 2'-O-methyluridine-5'-phosphate
  modified_base (5)..(5): 2'-O-methylcytidine-5'-phosphate
  modified_base (8)..(8): 2'-O-methyluridine-5'-phosphate
  modified_base (9)..(9): 2'-O-methylcytidine-5'-phosphate
  modified_base (12)..(12): 2'-O-methyluridine-5'-phosphate
  modified_base (13)..(13): 2'-O-methylcytidine-5'-phosphate
  modified_base (14)..(14): 2'-O-methyluridine-5'-phosphate
  modified_base (15)..(16): 2'-O-methylcytidine-5'-phosphate
  modified_base (21)..(21): 2'-deoxy-thymidine-5'-phosphate-phosphorothioate
ngagngannaannnnngaatt

SEQ ID NO: 514 - DNA, 21 bp, Artificial Sequence
  Description of Artificial Sequence: Synthetic oligonucleotide
  modified_base (18)..(18): 2'-O-methylcytidine-5'-phosphate
  modified_base (21)..(21): 2'-deoxy-thymidine-5'-phosphate-phosphorothioate
uucggagauugaucgcunatt

SEQ ID NO: 515 - DNA, 21 bp, Artificial Sequence
  Description of Artificial Sequence: Synthetic oligonucleotide
  modified_base (4)..(4): 2'-O-methylcytidine-5'-phosphate
  modified_base (7)..(7): 2'-O-methyluridine-5'-phosphate
  modified_base (8)..(8): 2'-O-methylcytidine-5'-phosphate
  modified_base (11)..(11): 2'-O-methyluridine-5'-phosphate
  modified_base (12)..(12): 2'-O-methylcytidine-5'-phosphate
  modified_base (13)..(13): 2'-O-methyluridine-5'-phosphate
  modified_base (14)..(15): 2'-O-methylcytidine-5'-phosphate
  modified_base (21)..(21): 2'-deoxy-thymidine-5'-phosphate-phosphorothioate
gagngannaannnnngaaatt

SEQ ID NO: 516 - DNA, 21 bp, Artificial Sequence
  Description of Artificial Sequence: Synthetic oligonucleotide
  modified_base (1)..(2): 2'-O-methyluridine-5'-phosphate
  modified_base (10)..(11): 2'-O-methyluridine-5'-phosphate
  modified_base (21)..(21): 2'-deoxy-thymidine-5'-phosphate-phosphorothioate
nnucggaganngaucgcuctt

SEQ ID NO: 517 - DNA, 21 bp, Artificial Sequence
  Description of Artificial Sequence: Synthetic oligonucleotide
  modified_base (1)..(1): 2'-O-methylcytidine-5'-phosphate
  modified_base (4)..(4): 2'-O-methylcytidine-5'-phosphate
  modified_base (6)..(6): 2'-O-methylcytidine-5'-phosphate
  modified_base (8)..(8): 2'-O-methylcytidine-5'-phosphate
  modified_base (9)..(10): 2'-O-methyluridine-5'-phosphate
  modified_base (13)..(13): 2'-O-methyluridine-5'-phosphate
  modified_base (16)..(16): 2'-O-methyluridine-5'-phosphate
  modified_base (18)..(18): 2'-O-methyluridine-5'-phosphate
  modified_base (19)..(19): 2'-O-methylcytidine-5'-phosphate
  modified_base (21)..(21): 2'-deoxy-thymidine-5'-phosphate-phosphorothioate
naangngnnnganggnanntt

SEQ ID NO: 518 - DNA, 21 bp, Artificial Sequence
  Description of Artificial Sequence: Synthetic oligonucleotide
  modified_base (3)..(3): 2'-O-methyluridine-5'-phosphate
  modified_base (6)..(6): 2'-O-methylcytidine-5'-phosphate
  modified_base (9)..(9): 2'-O-methylcytidine-5'-phosphate
  modified_base (21)..(21): 2'-deoxy-thymidine-5'-phosphate-phosphorothioate
ganacnaunaagcgcguugtt

SEQ ID NO: 519 - DNA, 21 bp, Artificial Sequence
  Description of Artificial Sequence: Synthetic oligonucleotide
  modified_base (3)..(3): 2'-O-methylcytidine-5'-phosphate
  modified_base (5)..(5): 2'-O-methylcytidine-5'-phosphate
  modified_base (7)..(7): 2'-O-methylcytidine-5'-phosphate
  modified_base (8)..(9): 2'-O-methyluridine-5'-phosphate
  modified_base (12)..(12): 2'-O-methyluridine-5'-phosphate
  modified_base (15)..(15): 2'-O-methyluridine-5'-phosphate
  modified_base (17)..(17): 2'-O-methyluridine-5'-phosphate
  modified_base (18)..(18): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
aangngnnnganggnannntt

SEQ ID NO: 520 - DNA, 21 bp, Artificial Sequence
  Description of Artificial Sequence: Synthetic oligonucleotide
  modified_base (4)..(4): 2'-O-methyluridine-5'-phosphate
  modified_base (7)..(7): 2'-O-methylcytidine-5'-phosphate
  modified_base (10)..(10): 2'-O-methylcytidine-5'-phosphate
  modified_base (21)..(21): 2'-deoxy-thymidine-5'-phosphate-phosphorothioate
aganacnaunaagcgcguutt

SEQ ID NO: 521 - DNA, 21 bp, Artificial Sequence
  Description of Artificial Sequence: Synthetic oligonucleotide
  modified_base (2)..(2): 2'-O-methyluridine-5'-phosphate
  modified_base (4)..(4): 2'-O-methylcytidine-5'-phosphate
  modified_base (6)..(8): 2'-O-methylcytidine-5'-phosphate
  modified_base (14)..(14): 2'-O-methylcytidine-5'-phosphate
  modified_base (15)..(16): 2'-O-methyluridine-5'-phosphate
  modified_base (21)..(21): 2'-deoxy-thymidine-5'-phosphate-phosphorothioate
anangnnnaagaannnaggtt

SEQ ID NO: 522 - DNA, 21 bp, Artificial Sequence
  Description of Artificial Sequence: Synthetic oligonucleotide
  modified_base (3)..(3): 2'-O-methyluridine-5'-phosphate
  modified_base (17)..(17): 2'-O-methyluridine-5'-phosphate
  modified_base (21)..(21): 2'-deoxy-thymidine-5'-phosphate-phosphorothioate
ccnaaguucuugggcgnautt

SEQ ID NO: 523 - DNA, 21 bp, Artificial Sequence
  Description of Artificial Sequence: Synthetic oligonucleotide
  modified_base (3)..(5): 2'-O-methylcytidine-5'-phosphate
  modified_base (7)..(7): 2'-O-methylcytidine-5'-phosphate
  modified_base (8)..(8): 2'-O-methyluridine-5'-phosphate
  modified_base (10)..(11): 2'-O-methyluridine-5'-phosphate
  modified_base (15)..(16): 2'-O-methylcytidine-5'-phosphate
  modified_base (21)..(21): 2'-deoxy-thymidine-5'-phosphate-phosphorothioate
agnnngnnannaagnngagtt

SEQ ID NO: 524 - DNA, 21 bp, Artificial Sequence
  Description of Artificial Sequence: Synthetic oligonucleotide
  modified_base (8)..(8): 2'-O-methyluridine-5'-phosphate
  modified_base (11)..(11): 2'-O-methyluridine-5'-phosphate
  modified_base (21)..(21): 2'-deoxy-thymidine-5'-phosphate-phosphorothioate
cucggcunaanagcgggcutt

SEQ ID NO: 525 - DNA, 21 bp, Artificial Sequence
  Description of Artificial Sequence: Synthetic oligonucleotide
  modified_base (1)..(2): 2'-O-methyluridine-5'-phosphate
  modified_base (4)..(4): 2'-O-methyluridine-5'-phosphate
  modified_base (5)..(5): 2'-O-methylcytidine-5'-phosphate
  modified_base (8)..(9): 2'-O-methyluridine-5'-phosphate
  modified_base (12)..(12): 2'-O-methylcytidine-5'-phosphate
  modified_base (15)..(15): 2'-O-methyluridine-5'-phosphate
  modified_base (16)..(17): 2'-O-methylcytidine-5'-phosphate
  modified_base (18)..(19): 2'-O-methyluridine-5'-phosphate
  modified_base (21)..(21): 2'-deoxy-thymidine-5'-phosphate-phosphorothioate
nnanngannganagnnnnntt

SEQ ID NO: 526 - DNA, 21 bp, Artificial Sequence
  Description of Artificial Sequence: Synthetic oligonucleotide
  modified_base (10)..(10): 2'-O-methylcytidine-5'-phosphate
  modified_base (17)..(17): 2'-O-methyluridine-5'-phosphate
  modified_base (21)..(21): 2'-deoxy-thymidine-5'-phosphate-phosphorothioate
aaggacugunaaucganaatt

SEQ ID NO: 527 - DNA, 21 bp, Artificial Sequence
  Description of Artificial Sequence: Synthetic oligonucleotide
  modified_base (4)..(5): 2'-O-methylcytidine-5'-phosphate
  modified_base (8)..(8): 2'-O-methyluridine-5'-phosphate
  modified_base (10)..(12): 2'-O-methyluridine-5'-phosphate
  modified_base (15)..(15): 2'-O-methylcytidine-5'-phosphate
  modified_base (17)..(18): 2'-O-methylcytidine-5'-phosphate
  modified_base (21)..(21): 2'-deoxy-thymidine-5'-phosphate-phosphorothioate
aganngangnnnaangnngtt

SEQ ID NO: 528 - DNA, 21 bp, Artificial Sequence
  Description of Artificial Sequence: Synthetic oligonucleotide
  modified_base (7)..(7): 2'-O-methyluridine-5'-phosphate
  modified_base (11)..(11): 2'-O-methylcytidine-5'-phosphate
  modified_base (21)..(21): 2'-deoxy-thymidine-5'-phosphate-phosphorothioate
cggcgunaaanaucggucutt

SEQ ID NO: 529 - DNA, 21 bp, Artificial Sequence
  Description of Artificial Sequence: Synthetic oligonucleotide
  modified_base (2)..(3): 2'-O-methylcytidine-5'-phosphate
  modified_base (5)..(5): 2'-O-methyluridine-5'-phosphate
  modified_base (7)..(7): 2'-O-methyluridine-5'-phosphate
  modified_base (9)..(10): 2'-O-methyluridine-5'-phosphate
  modified_base (12)..(12): 2'-O-methyluridine-5'-phosphate
  modified_base (13)..(13): 2'-O-methylcytidine-5'-phosphate
  modified_base (15)..(15): 2'-O-methylcytidine-5'-phosphate
  modified_base (16)..(17): 2'-O-methyluridine-5'-phosphate
  modified_base (18)..(18): 2'-O-methylcytidine-5'-phosphate
  modified_base (21)..(21): 2'-deoxy-thymidine-5'-phosphate-phosphorothioate
annanananngnngnnnnatt

SEQ ID NO: 530 - DNA, 21 bp, Artificial Sequence
  Description of Artificial Sequence: Synthetic oligonucleotide
  modified_base (9)..(9): 2'-O-methylcytidine-5'-phosphate
  modified_base (12)..(12): 2'-O-methyluridine-5'-phosphate
  modified_base (14)..(14): 2'-O-methyluridine-5'-phosphate
  modified_base (21)..(21): 2'-deoxy-thymidine-5'-phosphate-phosphorothioate
ugaagcganaananauggutt

SEQ ID NO: 531 - DNA, 21 bp, Artificial Sequence
  Description of Artificial Sequence: Synthetic oligonucleotide
  modified_base (2)..(2): 2'-O-methyluridine-5'-phosphate
  modified_base (4)..(5): 2'-O-methyluridine-5'-phosphate
  modified_base (7)..(7): 2'-O-methyluridine-5'-phosphate
  modified_base (9)..(9): 2'-O-methylcytidine-5'-phosphate
  modified_base (11)..(11): 2'-O-methyluridine-5'-phosphate
  modified_base (12)..(12): 2'-O-methylcytidine-5'-phosphate
  modified_base (15)..(15): 2'-O-methyluridine-5'-phosphate
  modified_base (17)..(17): 2'-O-methyluridine-5'-phosphate
  modified_base (21)..(21): 2'-deoxy-thymidine-5'-phosphate-phosphorothioate
ananngngnannggnanaatt

SEQ ID NO: 532 - DNA, 21 bp, Artificial Sequence
  Description of Artificial Sequence: Synthetic oligonucleotide
  modified_base (2)..(2): 2'-O-methyluridine-5'-phosphate
  modified_base (4)..(4): 2'-O-methyluridine-5'-phosphate
  modified_base (12)..(12): 2'-O-methylcytidine-5'-phosphate
  modified_base (14)..(14): 2'-O-methylcytidine-5'-phosphate
  modified_base (17)..(17): 2'-O-methyluridine-5'-phosphate
  modified_base (21)..(21): 2'-deoxy-thymidine-5'-phosphate-phosphorothioate
unanaccgaugnanaanautt

SEQ ID NO: 533 - DNA, 21 bp, Artificial Sequence
  Description of Artificial Sequence: Synthetic oligonucleotide
  modified_base (1)..(2): 2'-O-methyluridine-5'-phosphate
  modified_base (5)..(5): 2'-O-methylcytidine-5'-phosphate
  modified_base (7)..(8): 2'-O-methylcytidine-5'-phosphate
  modified_base (13)..(14): 2'-O-methyluridine-5'-phosphate
  modified_base (18)..(19): 2'-O-methyluridine-5'-phosphate
  modified_base (21)..(21): 2'-deoxy-thymidine-5'-phosphate-phosphorothioate
nnaangnnggganngaanntt

SEQ ID NO: 534 - DNA, 21 bp, Artificial Sequence
  Description of Artificial Sequence: Synthetic oligonucleotide
  modified_base (5)..(5): 2'-O-methylcytidine-5'-phosphate
  modified_base (17)..(17): 2'-O-methyluridine-5'-phosphate
  modified_base (21)..(21): 2'-deoxy-thymidine-5'-phosphate-phosphorothioate
aauunaaucccggcgunaatt

SEQ ID NO: 535 - DNA, 21 bp, Artificial Sequence
  Description of Artificial Sequence: Synthetic oligonucleotide
  modified_base (1)..(1): 2'-O-methyluridine-5'-phosphate
  modified_base (3)..(3): 2'-O-methylcytidine-5'-phosphate
  modified_base (5)..(5): 2'-O-methylcytidine-5'-phosphate
  modified_base (14)..(14): 2'-O-methyluridine-5'-phosphate
  modified_base (15)..(15): 2'-O-methylcytidine-5'-phosphate
  modified_base (19)..(19): 2'-O-methylcytidine-5'-phosphate
  modified_base (21)..(21): 2'-deoxy-thymidine-5'-phosphate-phosphorothioate
ngnangaaaaagannggantt

SEQ ID NO: 536 - DNA, 21 bp, Artificial Sequence
  Description of Artificial Sequence: Synthetic oligonucleotide
  modified_base (18)..(18): 2'-O-methylcytidine-5'-phosphate
  modified_base (21)..(21): 2'-deoxy-thymidine-5'-phosphate-phosphorothioate
guccgaucuuuuucgugnatt

SEQ ID NO: 537 - DNA, 21 bp, Artificial Sequence
  Description of Artificial Sequence: Synthetic oligonucleotide
  modified_base (3)..(3): 2'-O-methyluridine-5'-phosphate
  modified_base (4)..(4): 2'-O-methylcytidine-5'-phosphate
  modified_base (7)..(9): 2'-O-methylcytidine-5'-phosphate
  modified_base (11)..(11): 2'-O-methylcytidine-5'-phosphate
  modified_base (12)..(12): 2'-O-methyluridine-5'-phosphate
  modified_base (14)..(15): 2'-O-methyluridine-5'-phosphate
  modified_base (19)..(19): 2'-O-methylcytidine-5'-phosphate
  modified_base (21)..(21): 2'-deoxy-thymidine-5'-phosphate-phosphorothioate
ggnnagnnngnnannaagntt

SEQ ID NO: 538 - DNA, 21 bp, Artificial Sequence
  Description of Artificial Sequence: Synthetic oligonucleotide
  modified_base (4)..(4): 2'-O-methyluridine-5'-phosphate
  modified_base (7)..(7): 2'-O-methyluridine-5'-phosphate
  modified_base (21)..(21): 2'-deoxy-thymidine-5'-phosphate-phosphorothioate
gcunaanagcgggcugacctt

SEQ ID NO: 539 - DNA, 21 bp, Artificial Sequence
  Description of Artificial Sequence: Synthetic oligonucleotide
  modified_base (5)..(6): 2'-O-methyluridine-5'-phosphate
  modified_base (8)..(8): 2'-O-methyluridine-5'-phosphate
  modified_base (11)..(11): 2'-O-methylcytidine-5'-phosphate
  modified_base (13)..(13): 2'-O-methylcytidine-5'-phosphate
  modified_base (16)..(17): 2'-O-methyluridine-5'-phosphate
  modified_base (21)..(21): 2'-deoxy-thymidine-5'-phosphate-phosphorothioate
ggaanngnagngnaanngatt

SEQ ID NO: 540 - DNA, 21 bp, Artificial Sequence
  Description of Artificial Sequence: Synthetic oligonucleotide
  modified_base (2)..(2): 2'-O-methylcytidine-5'-phosphate
  modified_base (11)..(11): 2'-O-methyluridine-5'-phosphate
  modified_base (13)..(13): 2'-O-methylcytidine-5'-phosphate
  modified_base (21)..(21): 2'-deoxy-thymidine-5'-phosphate-phosphorothioate
unaauugcgcnanaauucctt

SEQ ID NO: 541 - DNA, 21 bp, Artificial Sequence
  Description of Artificial Sequence: Synthetic oligonucleotide
  modified_base (2)..(2): 2'-O-methylcytidine-5'-phosphate
  modified_base (3)..(3): 2'-O-methyluridine-5'-phosphate
  modified_base (5)..(6): 2'-O-methylcytidine-5'-phosphate
  modified_base (8)..(8): 2'-O-methyluridine-5'-phosphate
  modified_base (10)..(10): 2'-O-methyluridine-5'-phosphate
  modified_base (12)..(13): 2'-O-methyluridine-5'-phosphate
  modified_base (15)..(15): 2'-O-methyluridine-5'-phosphate
  modified_base (16)..(16): 2'-O-methylcytidine-5'-phosphate
  modified_base (18)..(18): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
annannanananngnngnntt

SEQ ID NO: 542 - DNA, 21 bp, Artificial Sequence
  Description of Artificial Sequence: Synthetic oligonucleotide
  modified_base (6)..(6): 2'-O-methylcytidine-5'-phosphate
  modified_base (9)..(9): 2'-O-methyluridine-5'-phosphate
  modified_base (11)..(11): 2'-O-methyluridine-5'-phosphate
  modified_base (16)..(16): 2'-O-methyluridine-5'-phosphate
  modified_base (21)..(21): 2'-deoxy-thymidine-5'-phosphate-phosphorothioate
agcganaananauggnagutt

SEQ ID NO: 543 - DNA, 21 bp, Artificial Sequence
  Description of Artificial Sequence: Synthetic oligonucleotide
  modified_base (2)..(3): 2'-O-methylcytidine-5'-phosphate
  modified_base (6)..(6): 2'-O-methyluridine-5'-phosphate
  modified_base (8)..(10): 2'-O-methyluridine-5'-phosphate
  modified_base (13)..(13): 2'-O-methylcytidine-5'-phosphate
  modified_base (15)..(16): 2'-O-methylcytidine-5'-phosphate
  modified_base (21)..(21): 2'-deoxy-thymidine-5'-phosphate-phosphorothioate
anngangnnnaangnngggtt

SEQ ID NO: 544 - DNA, 21 bp, Artificial Sequence
  Description of Artificial Sequence: Synthetic oligonucleotide
  modified_base (9)..(9): 2'-O-methyluridine-5'-phosphate
  modified_base (13)..(13): 2'-O-methylcytidine-5'-phosphate
  modified_base (21)..(21): 2'-deoxy-thymidine-5'-phosphate-phosphorothioate
cccggcgunaaanaucggutt

SEQ ID NO: 545 - DNA, 21 bp, Artificial Sequence
  Description of Artificial Sequence: Synthetic oligonucleotide
  modified_base (1)..(1): 2'-O-methyluridine-5'-phosphate
  modified_base (4)..(4): 2'-O-methyluridine-5'-phosphate
  modified_base (9)..(9): 2'-O-methylcytidine-5'-phosphate
  modified_base (10)..(12): 2'-O-methyluridine-5'-phosphate
  modified_base (13)..(13): 2'-O-methylcytidine-5'-phosphate
  modified_base (15)..(15): 2'-O-methyluridine-5'-phosphate
  modified_base (17)..(17): 2'-O-methylcytidine-5'-phosphate
  modified_base (19)..(19): 2'-O-methylcytidine-5'-phosphate
  modified_base (21)..(21): 2'-deoxy-thymidine-5'-phosphate-phosphorothioate
ngangagannnnngnanantt

SEQ ID NO: 546 - DNA, 21 bp, Artificial Sequence
  Description of Artificial Sequence: Synthetic oligonucleotide
  modified_base (4)..(4): 2'-O-methyluridine-5'-phosphate
  modified_base (15)..(15): 2'-O-methylcytidine-5'-phosphate
  modified_base (18)..(18): 2'-O-methylcytidine-5'-phosphate
  modified_base (21)..(21): 2'-deoxy-thymidine-5'-phosphate-phosphorothioate
gugnacgaaagucunaunatt

SEQ ID NO: 547 - DNA, 21 bp, Artificial Sequence
  Description of Artificial Sequence: Synthetic oligonucleotide
  modified_base (2)..(2): 2'-O-methylcytidine-5'-phosphate
  modified_base (11)..(11): 2'-O-methylcytidine-5'-phosphate
  modified_base (14)..(18): 2'-O-methyluridine-5'-phosphate
  modified_base (21)..(21): 2'-deoxy-thymidine-5'-phosphate-phosphorothioate
angaaaagggnggnnnnnatt

SEQ ID NO: 548 - DNA, 21 bp, Artificial Sequence
  Description of Artificial Sequence: Synthetic oligonucleotide
  modified_base (1)..(1): 2'-O-methyluridine-5'-phosphate
  modified_base (21)..(21): 2'-deoxy-thymidine-5'-phosphate-phosphorothioate
naaaaaccgcccuuuucgutt

SEQ ID NO: 549 - DNA, 21 bp, Artificial Sequence
  Description of Artificial Sequence: Synthetic oligonucleotide
  modified_base (1)..(2): 2'-O-methylcytidine-5'-phosphate
  modified_base (5)..(5): 2'-O-methyluridine-5'-phosphate
  modified_base (7)..(9): 2'-O-methyluridine-5'-phosphate
  modified_base (12)..(12): 2'-O-methylcytidine-5'-phosphate
  modified_base (14)..(15): 2'-O-methylcytidine-5'-phosphate
  modified_base (21)..(21): 2'-deoxy-thymidine-5'-phosphate-phosphorothioate
nngangnnnaangnngggatt

SEQ ID NO: 550 - DNA, 21 bp, Artificial Sequence
  Description of Artificial Sequence: Synthetic oligonucleotide
  modified_base (10)..(10): 2'-O-methyluridine-5'-phosphate
  modified_base (14)..(14): 2'-O-methylcytidine-5'-phosphate
  modified_base (21)..(21): 2'-deoxy-thymidine-5'-phosphate-phosphorothioate
ucccggcgunaaanaucggtt

SEQ ID NO: 551 - DNA, 21 bp, Artificial Sequence
  Description of Artificial Sequence: Synthetic oligonucleotide
  modified_base (2)..(2): 2'-O-methyluridine-5'-phosphate
  modified_base (3)..(3): 2'-O-methylcytidine-5'-phosphate
  modified_base (6)..(6): 2'-O-methyluridine-5'-phosphate
  modified_base (7)..(7): 2'-O-methylcytidine-5'-phosphate
  modified_base (8)..(8): 2'-O-methyluridine-5'-phosphate
  modified_base (9)..(10): 2'-O-methylcytidine-5'-phosphate
  modified_base (15)..(15): 2'-O-methylcytidine-5'-phosphate
  modified_base (16)..(16): 2'-O-methyluridine-5'-phosphate
  modified_base (21)..(21): 2'-deoxy-thymidine-5'-phosphate-phosphorothioate
annaannnnngaaannagatt

SEQ ID NO: 552 - DNA, 21 bp, Artificial Sequence
  Description of Artificial Sequence: Synthetic oligonucleotide
  modified_base (3)..(3): 2'-O-methyluridine-5'-phosphate
  modified_base (21)..(21): 2'-deoxy-thymidine-5'-phosphate-phosphorothioate
ucnaguuucggagauugautt

SEQ ID NO: 553 - DNA, 21 bp, Artificial Sequence
  Description of Artificial Sequence: Synthetic oligonucleotide
  modified_base (4)..(4): 2'-O-methyluridine-5'-phosphate
  modified_base (6)..(6): 2'-O-methylcytidine-5'-phosphate
  modified_base (9)..(9): 2'-O-methylcytidine-5'-phosphate
  modified_base (11)..(12): 2'-O-methyluridine-5'-phosphate
  modified_base (19)..(19): 2'-O-methyluridine-5'-phosphate
  modified_base (21)..(21): 2'-deoxy-thymidine-5'-phosphate-phosphorothioate
aaananggngnnaagaagntt

SEQ ID NO: 554 - DNA, 21 bp, Artificial Sequence
  Description of Artificial Sequence: Synthetic oligonucleotide
  modified_base (7)..(7): 2'-O-methyluridine-5'-phosphate
  modified_base (15)..(15): 2'-O-methyluridine-5'-phosphate
  modified_base (21)..(21): 2'-deoxy-thymidine-5'-phosphate-phosphorothioate
acuucunaacgccgnauuutt

SEQ ID NO: 555 - DNA, 21 bp, Artificial Sequence
  Description of Artificial Sequence: Synthetic oligonucleotide
  modified_base (5)..(5): 2'-O-methyluridine-5'-phosphate
  modified_base (7)..(7): 2'-O-methylcytidine-5'-phosphate
  modified_base (10)..(10): 2'-O-methylcytidine-5'-phosphate
  modified_base (12)..(13): 2'-O-methyluridine-5'-phosphate
  modified_base (21)..(21): 2'-deoxy-thymidine-5'-phosphate-phosphorothioate
aaaananggngnnaagaagtt

SEQ ID NO: 556 - DNA, 21 bp, Artificial Sequence
  Description of Artificial Sequence: Synthetic oligonucleotide
  modified_base (6)..(6): 2'-O-methyluridine-5'-phosphate
  modified_base (14)..(14): 2'-O-methyluridine-5'-phosphate
  modified_base (21)..(21): 2'-deoxy-thymidine-5'-phosphate-phosphorothioate
cuucunaacgccgnauuuutt

SEQ ID NO: 557 - DNA, 21 bp, Artificial Sequence
  Description of Artificial Sequence: Synthetic oligonucleotide
  modified_base (1)..(1): 2'-O-methyluridine-5'-phosphate
  modified_base (2)..(2): 2'-O-methylcytidine-5'-phosphate
  modified_base (6)..(8): 2'-O-methylcytidine-5'-phosphate
  modified_base (12)..(12): 2'-O-methylcytidine-5'-phosphate
  modified_base (13)..(14): 2'-O-methyluridine-5'-phosphate
  modified_base (16)..(16): 2'-O-methyluridine-5'-phosphate
  modified_base (17)..(17): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
nngaannnagannnannantt

SEQ ID NO: 558 - DNA, 21 bp, Artificial Sequence
  Description of Artificial Sequence: Synthetic oligonucleotide
  modified_base (5)..(5): 2'-O-methyluridine-5'-phosphate
  modified_base (21)..(21): 2'-deoxy-thymidine-5'-phosphate-phosphorothioate
auganaagucuggguucgatt

SEQ ID NO: 559 - DNA, 21 bp, Artificial Sequence
  Description of Artificial Sequence: Synthetic oligonucleotide
  modified_base (2)..(2): 2'-O-methylcytidine-5'-phosphate
  modified_base (5)..(6): 2'-O-methylcytidine-5'-phosphate
  modified_base (8)..(8): 2'-O-methylcytidine-5'-phosphate
  modified_base (10)..(10): 2'-O-methylcytidine-5'-phosphate
  modified_base (11)..(11): 2'-O-methyluridine-5'-phosphate
  modified_base (15)..(15): 2'-O-methyluridine-5'-phosphate
  modified_base (16)..(16): 2'-O-methylcytidine-5'-phosphate
  modified_base (17)..(17): 2'-O-methyluridine-5'-phosphate
  modified_base (21)..(21): 2'-deoxy-thymidine-5'-phosphate-phosphorothioate
anaannangnnaaannnagtt

SEQ ID NO: 560 - DNA, 21 bp, Artificial Sequence
  Description of Artificial Sequence: Synthetic oligonucleotide
  modified_base (2)..(2): 2'-O-methyluridine-5'-phosphate
  modified_base (8)..(8): 2'-O-methyluridine-5'-phosphate
  modified_base (21)..(21): 2'-deoxy-thymidine-5'-phosphate-phosphorothioate
cnagauunagcgugguugutt

SEQ ID NO: 561 - DNA, 21 bp, Artificial Sequence
  Description of Artificial Sequence: Synthetic oligonucleotide
  modified_base (2)..(2): 2'-O-methylcytidine-5'-phosphate
  modified_base (5)..(5): 2'-O-methylcytidine-5'-phosphate
  modified_base (6)..(7): 2'-O-methyluridine-5'-phosphate
  modified_base (9)..(9): 2'-O-methyluridine-5'-phosphate
  modified_base (10)..(10): 2'-O-methylcytidine-5'-phosphate
  modified_base (13)..(14): 2'-O-methyluridine-5'-phosphate
  modified_base (17)..(17): 2'-O-methylcytidine-5'-phosphate
  modified_base (21)..(21): 2'-deoxy-thymidine-5'-phosphate-phosphorothioate
gnaannnanngannganagtt

SEQ ID NO: 562 - DNA, 21 bp, Artificial Sequence
  Description of Artificial Sequence: Synthetic oligonucleotide
  modified_base (5)..(5): 2'-O-methylcytidine-5'-phosphate
  modified_base (12)..(12): 2'-O-methyluridine-5'-phosphate
  modified_base (21)..(21): 2'-deoxy-thymidine-5'-phosphate-phosphorothioate
cugunaaucganaaguugctt

SEQ ID NO: 563 - DNA, 21 bp, Artificial Sequence
  Description of Artificial Sequence: Synthetic oligonucleotide
  modified_base (3)..(3): 2'-O-methylcytidine-5'-phosphate
  modified_base (7)..(7): 2'-O-methyluridine-5'-phosphate
  modified_base (10)..(10): 2'-O-methylcytidine-5'-phosphate
  modified_base (11)..(11): 2'-O-methyluridine-5'-phosphate
  modified_base (15)..(15): 2'-O-methylcytidine-5'-phosphate
  modified_base (16)..(16): 2'-O-methyluridine-5'-phosphate
  modified_base (19)..(19): 2'-O-methyluridine-5'-phosphate
  modified_base (21)..(21): 2'-deoxy-thymidine-5'-phosphate-phosphorothioate
gangganaannaaannagntt

SEQ ID NO: 564 - DNA, 21 bp, Artificial Sequence
  Description of Artificial Sequence: Synthetic oligonucleotide
  modified_base (3)..(3): 2'-O-methyluridine-5'-phosphate
  modified_base (8)..(8): 2'-O-methyluridine-5'-phosphate
  modified_base (12)..(12): 2'-O-methyluridine-5'-phosphate
  modified_base (21)..(21): 2'-deoxy-thymidine-5'-phosphate-phosphorothioate
acnaguunagunauccguctt

SEQ ID NO: 565 - DNA, 21 bp, Artificial Sequence
  Description of Artificial Sequence: Synthetic oligonucleotide
  modified_base (1)..(1): 2'-O-methyluridine-5'-phosphate
  modified_base (3)..(3): 2'-O-methyluridine-5'-phosphate
  modified_base (6)..(6): 2'-O-methylcytidine-5'-phosphate
  modified_base (8)..(8): 2'-O-methylcytidine-5'-phosphate
  modified_base (11)..(12): 2'-O-methyluridine-5'-phosphate
  modified_base (15)..(15): 2'-O-methylcytidine-5'-phosphate
  modified_base (16)..(18): 2'-O-methyluridine-5'-phosphate
  modified_base (21)..(21): 2'-deoxy-thymidine-5'-phosphate-phosphorothioate
ngnagngnaanngannnngtt

SEQ ID NO: 566 - DNA, 21 bp, Artificial Sequence
  Description of Artificial Sequence: Synthetic oligonucleotide
  modified_base (1)..(1): 2'-O-methylcytidine-5'-phosphate
  modified_base (7)..(7): 2'-O-methylcytidine-5'-phosphate
  modified_base (16)..(16): 2'-O-methyluridine-5'-phosphate
  modified_base (18)..(18): 2'-O-methylcytidine-5'-phosphate
  modified_base (21)..(21): 2'-deoxy-thymidine-5'-phosphate-phosphorothioate
naaagunaauugcgcnanatt

SEQ ID NO: 567 - DNA, 21 bp, Artificial Sequence
  Description of Artificial Sequence: Synthetic oligonucleotide
  modified_base (4)..(4): 2'-O-methylcytidine-5'-phosphate
  modified_base (8)..(8): 2'-O-methyluridine-5'-phosphate
  modified_base (11)..(11): 2'-O-methylcytidine-5'-phosphate
  modified_base (12)..(12): 2'-O-methyluridine-5'-phosphate
  modified_base (16)..(16): 2'-O-methylcytidine-5'-phosphate
  modified_base (17)..(17): 2'-O-methyluridine-5'-phosphate
  modified_base (21)..(21): 2'-deoxy-thymidine-5'-phosphate-phosphorothioate
ggangganaannaaannagtt

SEQ ID NO: 568 - DNA, 21 bp, Artificial Sequence
  Description of Artificial Sequence: Synthetic oligonucleotide
  modified_base (2)..(2): 2'-O-methyluridine-5'-phosphate
  modified_base (7)..(7): 2'-O-methyluridine-5'-phosphate
  modified_base (11)..(11): 2'-O-methyluridine-5'-phosphate
  modified_base (21)..(21): 2'-deoxy-thymidine-5'-phosphate-phosphorothioate
cnaguunagunauccgucctt

SEQ ID NO: 569 - DNA, 21 bp, Artificial Sequence
  Description of Artificial Sequence: Synthetic oligonucleotide
  modified_base (1)..(1): 2'-O-methyluridine-5'-phosphate
  modified_base (4)..(4): 2'-O-methylcytidine-5'-phosphate
  modified_base (5)..(5): 2'-O-methyluridine-5'-phosphate
  modified_base (7)..(9): 2'-O-methylcytidine-5'-phosphate
  modified_base (12)..(12): 2'-O-methylcytidine-5'-phosphate
  modified_base (14)..(14): 2'-O-methyluridine-5'-phosphate
  modified_base (16)..(16): 2'-O-methylcytidine-5'-phosphate
  modified_base (18)..(18): 2'-O-methylcytidine-5'-phosphate
  modified_base (21)..(21): 2'-deoxy-thymidine-5'-phosphate-phosphorothioate
nggnnannnaananananatt

SEQ ID NO: 570 - DNA, 21 bp, Artificial Sequence
  Description of Artificial Sequence: Synthetic oligonucleotide
  modified_base (5)..(5): 2'-O-methyluridine-5'-phosphate
  modified_base (14)..(14): 2'-O-methyluridine-5'-phosphate
  modified_base (18)..(18): 2'-O-methylcytidine-5'-phosphate
  modified_base (21)..(21): 2'-deoxy-thymidine-5'-phosphate-phosphorothioate
ugugnauguugggnagcnatt

SEQ ID NO: 571 - DNA, 21 bp, Artificial Sequence
  Description of Artificial Sequence: Synthetic oligonucleotide
  modified_base (2)..(4): 2'-O-methyluridine-5'-phosphate
  modified_base (7)..(7): 2'-O-methylcytidine-5'-phosphate
  modified_base (9)..(10): 2'-O-methylcytidine-5'-phosphate
  modified_base (15)..(16): 2'-O-methyluridine-5'-phosphate
  modified_base (21)..(21): 2'-deoxy-thymidine-5'-phosphate-phosphorothioate
gnnnaangnnggganngaatt

SEQ ID NO: 572 - DNA, 21 bp, Artificial Sequence
  Description of Artificial Sequence: Synthetic oligonucleotide
  modified_base (3)..(3): 2'-O-methylcytidine-5'-phosphate
  modified_base (15)..(15): 2'-O-methyluridine-5'-phosphate
  modified_base (21)..(21): 2'-deoxy-thymidine-5'-phosphate-phosphorothioate
uunaaucccggcgunaaactt

SEQ ID NO: 573 - DNA, 21 bp, Artificial Sequence
  Description of Artificial Sequence: Synthetic oligonucleotide
  modified_base (1)..(3): 2'-O-methyluridine-5'-phosphate
  modified_base (4)..(5): 2'-O-methylcytidine-5'-phosphate
  modified_base (7)..(9): 2'-O-methyluridine-5'-phosphate
  modified_base (12)..(12): 2'-O-methyluridine-5'-phosphate
  modified_base (14)..(14): 2'-O-methylcytidine-5'-phosphate
  modified_base (18)..(18): 2'-O-methylcytidine-5'-phosphate
  modified_base (21)..(21): 2'-deoxy-thymidine-5'-phosphate-phosphorothioate
nnnnngnnngangngaanatt

SEQ ID NO: 574 - DNA, 21 bp, Artificial Sequence
  Description of Artificial Sequence: Synthetic oligonucleotide
  modified_base (7)..(7): 2'-O-methylcytidine-5'-phosphate
  modified_base (10)..(10): 2'-O-methylcytidine-5'-phosphate
  modified_base (21)..(21): 2'-deoxy-thymidine-5'-phosphate-phosphorothioate
uguucgnaunaaacggaaatt

SEQ ID NO: 575 - DNA, 21 bp, Artificial Sequence
  Description of Artificial Sequence: Synthetic oligonucleotide
  modified_base (5)..(5): 2'-O-methylcytidine-5'-phosphate
  modified_base (6)..(6): 2'-O-methyluridine-5'-phosphate
  modified_base (8)..(8): 2'-O-methylcytidine-5'-phosphate
  modified_base (11)..(11): 2'-O-methylcytidine-5'-phosphate
  modified_base (15)..(15): 2'-O-methyluridine-5'-phosphate
  modified_base (17)..(18): 2'-O-methylcytidine-5'-phosphate
  modified_base (21)..(21): 2'-deoxy-thymidine-5'-phosphate-phosphorothioate
gaagnnanggngaanannatt

SEQ ID NO: 576 - DNA, 21 bp, Artificial Sequence
  Description of Artificial Sequence: Synthetic oligonucleotide
  modified_base (4)..(4): 2'-O-methyluridine-5'-phosphate
  modified_base (13)..(13): 2'-O-methyluridine-5'-phosphate
  modified_base (21)..(21): 2'-deoxy-thymidine-5'-phosphate-phosphorothioate
uggnauucgccgnagcuuctt

SEQ ID NO: 577 - DNA, 21 bp, Artificial Sequence
  Description of Artificial Sequence: Synthetic oligonucleotide
  modified_base (1)..(1): 2'-O-methyluridine-5'-phosphate
  modified_base (4)..(4): 2'-O-methyluridine-5'-phosphate
  modified_base (5)..(6): 2'-O-methylcytidine-5'-phosphate
  modified_base (7)..(7): 2'-O-methyluridine-5'-phosphate
  modified_base (9)..(10): 2'-O-methyluridine-5'-phosphate
  modified_base (11)..(11): 2'-O-methylcytidine-5'-phosphate
  modified_base (14)..(14): 2'-O-methyluridine-5'-phosphate
  modified_base (15)..(15): 2'-O-methylcytidine-5'-phosphate
  modified_base (16)..(16): 2'-O-methyluridine-5'-phosphate
  modified_base (21)..(21): 2'-deoxy-thymidine-5'-phosphate-phosphorothioate
nggnnnnannngannnagatt

SEQ ID NO: 578 - DNA, 21 bp, Artificial Sequence
  Description of Artificial Sequence: Synthetic oligonucleotide
  modified_base (3)..(3): 2'-O-methyluridine-5'-phosphate
  modified_base (12)..(12): 2'-O-methyluridine-5'-phosphate
  modified_base (18)..(18): 2'-O-methylcytidine-5'-phosphate
  modified_base (21)..(21): 2'-deoxy-thymidine-5'-phosphate-phosphorothioate
ucnagaucgaanaggacnatt

SEQ ID NO: 579 - DNA, 21 bp, Artificial Sequence
  Description of Artificial Sequence: Synthetic oligonucleotide
  modified_base (1)..(1): 2'-O-methyluridine-5'-phosphate
  modified_base (2)..(3): 2'-O-methylcytidine-5'-phosphate
  modified_base (5)..(7): 2'-O-methyluridine-5'-phosphate
  modified_base (10)..(10): 2'-O-methyluridine-5'-phosphate
  modified_base (12)..(12): 2'-O-methylcytidine-5'-phosphate
  modified_base (16)..(16): 2'-O-methylcytidine-5'-phosphate
  modified_base (21)..(21): 2'-deoxy-thymidine-5'-phosphate-phosphorothioate
nnngnnngangngaanaaatt

SEQ ID NO: 580 - DNA, 21 bp, Artificial Sequence
  Description of Artificial Sequence: Synthetic oligonucleotide
  modified_base (9)..(9): 2'-O-methylcytidine-5'-phosphate
  modified_base (12)..(12): 2'-O-methylcytidine-5'-phosphate
  modified_base (21)..(21): 2'-deoxy-thymidine-5'-phosphate-phosphorothioate
uuuguucgnaunaaacggatt

SEQ ID NO: 581 - DNA, 21 bp, Artificial Sequence
  Description of Artificial Sequence: Synthetic oligonucleotide
  modified_base (1)..(2): 2'-O-methylcytidine-5'-phosphate
  modified_base (4)..(5): 2'-O-methylcytidine-5'-phosphate
  modified_base (8)..(8): 2'-O-methylcytidine-5'-phosphate
  modified_base (9)..(9): 2'-O-methyluridine-5'-phosphate
  modified_base (10)..(12): 2'-O-methylcytidine-5'-phosphate
  modified_base (14)..(14): 2'-O-methyluridine-5'-phosphate
  modified_base (16)..(16): 2'-O-methyluridine-5'-phosphate
  modified_base (18)..(18): 2'-O-methylcytidine-5'-phosphate
  modified_base (21)..(21): 2'-deoxy-thymidine-5'-phosphate-phosphorothioate
nnannggnnnnngnananatt

SEQ ID NO: 582 - DNA, 21 bp, Artificial Sequence
  Description of Artificial Sequence: Synthetic oligonucleotide
  modified_base (3)..(3): 2'-O-methyluridine-5'-phosphate
  modified_base (5)..(5): 2'-O-methyluridine-5'-phosphate
  modified_base (21)..(21): 2'-deoxy-thymidine-5'-phosphate-phosphorothioate
ugnanacgggagccgguggtt

SEQ ID NO: 583 - DNA, 21 bp, Artificial Sequence
  Description of Artificial Sequence: Synthetic oligonucleotide
  modified_base (1)..(2): 2'-O-methylcytidine-5'-phosphate
  modified_base (5)..(5): 2'-O-methylcytidine-5'-phosphate
  modified_base (6)..(6): 2'-O-methyluridine-5'-phosphate
  modified_base (7)..(9): 2'-O-methylcytidine-5'-phosphate
  modified_base (11)..(11): 2'-O-methyluridine-5'-phosphate
  modified_base (13)..(13): 2'-O-methyluridine-5'-phosphate
  modified_base (15)..(15): 2'-O-methylcytidine-5'-phosphate
  modified_base (21)..(21): 2'-deoxy-thymidine-5'-phosphate-phosphorothioate
nnggnnnnngnananagagtt

SEQ ID NO: 584 - DNA, 21 bp, Artificial Sequence
  Description of Artificial Sequence: Synthetic oligonucleotide
  modified_base (6)..(6): 2'-O-methyluridine-5'-phosphate
  modified_base (8)..(8): 2'-O-methyluridine-5'-phosphate
  modified_base (21)..(21): 2'-deoxy-thymidine-5'-phosphate-phosphorothioate
cucugnanacgggagccggtt

SEQ ID NO: 585 - DNA, 21 bp, Artificial Sequence
  Description of Artificial Sequence: Synthetic oligonucleotide
  modified_base (6)..(6): 2'-O-methylcytidine-5'-phosphate
  modified_base (7)..(7): 2'-O-methyluridine-5'-phosphate
  modified_base (10)..(10): 2'-O-methyluridine-5'-phosphate
  modified_base (12)..(12): 2'-O-methylcytidine-5'-phosphate
  modified_base (15)..(15): 2'-O-methyluridine-5'-phosphate
  modified_base (17)..(17): 2'-O-methyluridine-5'-phosphate
  modified_base (18)..(19): 2'-O-methylcytidine-5'-phosphate
  modified_base (21)..(21): 2'-deoxy-thymidine-5'-phosphate-phosphorothioate
aagganngananaanannntt

SEQ ID NO: 586 - DNA, 21 bp, Artificial Sequence
  Description of Artificial Sequence: Synthetic oligonucleotide
  modified_base (4)..(4): 2'-O-methyluridine-5'-phosphate
  modified_base (9)..(9): 2'-O-methyluridine-5'-phosphate
  modified_base (12)..(12): 2'-O-methylcytidine-5'-phosphate
  modified_base (21)..(21): 2'-deoxy-thymidine-5'-phosphate-phosphorothioate
gganauugnaunaguccuutt

SEQ ID NO: 587 - DNA, 21 bp, Artificial Sequence
  Description of Artificial Sequence: Synthetic oligonucleotide
  modified_base (1)..(2): 2'-O-methylcytidine-5'-phosphate
  modified_base (4)..(6): 2'-O-methyluridine-5'-phosphate
  modified_base (9)..(9): 2'-O-methyluridine-5'-phosphate
  modified_base (11)..(11): 2'-O-methylcytidine-5'-phosphate
  modified_base (15)..(15): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
nngnnngangngaanaaantt

SEQ ID NO: 588 - DNA, 21 bp, Artificial Sequence
  Description of Artificial Sequence: Synthetic oligonucleotide
  modified_base (10)..(10): 2'-O-methylcytidine-5'-phosphate
  modified_base (13)..(13): 2'-O-methylcytidine-5'-phosphate
  modified_base (21)..(21): 2'-deoxy-thymidine-5'-phosphate-phosphorothioate
auuuguucgnaunaaacggtt

SEQ ID NO: 589 - DNA, 21 bp, Artificial Sequence
  Description of Artificial Sequence: Synthetic oligonucleotide
  modified_base (1)..(3): 2'-O-methylcytidine-5'-phosphate
  modified_base (5)..(5): 2'-O-methylcytidine-5'-phosphate
  modified_base (6)..(6): 2'-O-methyluridine-5'-phosphate
  modified_base (10)..(10): 2'-O-methylcytidine-5'-phosphate
  modified_base (13)..(13): 2'-O-methyluridine-5'-phosphate
  modified_base (15)..(16): 2'-O-methylcytidine-5'-phosphate
  modified_base (19)..(19): 2'-O-methylcytidine-5'-phosphate
  modified_base (21)..(21): 2'-deoxy-thymidine-5'-phosphate-phosphorothioate
nnnannggangangnngantt

SEQ ID NO: 590 - DNA, 21 bp, Artificial Sequence
  Description of Artificial Sequence: Synthetic oligonucleotide
  modified_base (6)..(6): 2'-O-methylcytidine-5'-phosphate
  modified_base (13)..(13): 2'-O-methylcytidine-5'-phosphate
  modified_base (21)..(21): 2'-deoxy-thymidine-5'-phosphate-phosphorothioate
gucggnaucgucnagugggtt

SEQ ID NO: 591 - DNA, 21 bp, Artificial Sequence
  Description of Artificial Sequence: Synthetic oligonucleotide
  modified_base (1)..(1): 2'-O-methylcytidine-5'-phosphate
  modified_base (3)..(3): 2'-O-methyluridine-5'-phosphate
  modified_base (6)..(6): 2'-O-methyluridine-5'-phosphate
  modified_base (11)..(11): 2'-O-methyluridine-5'-phosphate
  modified_base (16)..(16): 2'-O-methylcytidine-5'-phosphate
  modified_base (18)..(19): 2'-O-methylcytidine-5'-phosphate
  modified_base (21)..(21): 2'-deoxy-thymidine-5'-phosphate-phosphorothioate
ngnganggagngaagngnntt

SEQ ID NO: 592 - DNA, 21 bp, Artificial Sequence
  Description of Artificial Sequence: Synthetic oligonucleotide
  modified_base (8)..(8): 2'-O-methylcytidine-5'-phosphate
  modified_base (13)..(13): 2'-O-methylcytidine-5'-phosphate
  modified_base (16)..(16): 2'-O-methylcytidine-5'-phosphate
  modified_base (21)..(21): 2'-deoxy-thymidine-5'-phosphate-phosphorothioate
ggcgcuunacucnaunacgtt

SEQ ID NO: 593 - DNA, 21 bp, Artificial Sequence
  Description of Artificial Sequence: Synthetic oligonucleotide
  modified_base (1)..(3): 2'-O-methylcytidine-5'-phosphate
  modified_base (5)..(6): 2'-O-methylcytidine-5'-phosphate
  modified_base (9)..(9): 2'-O-methylcytidine-5'-phosphate
  modified_base (10)..(10): 2'-O-methyluridine-5'-phosphate
  modified_base (11)..(13): 2'-O-methylcytidine-5'-phosphate
  modified_base (15)..(15): 2'-O-methyluridine-5'-phosphate
  modified_base (17)..(17): 2'-O-methyluridine-5'-phosphate
  modified_base (19)..(19): 2'-O-methylcytidine-5'-phosphate
  modified_base (21)..(21): 2'-deoxy-thymidine-5'-phosphate-phosphorothioate
nnnannggnnnnngnanantt

SEQ ID NO: 594 - DNA, 21 bp, Artificial Sequence
  Description of Artificial Sequence: Synthetic oligonucleotide
  modified_base (2)..(2): 2'-O-methyluridine-5'-phosphate
  modified_base (4)..(4): 2'-O-methyluridine-5'-phosphate
  modified_base (21)..(21): 2'-deoxy-thymidine-5'-phosphate-phosphorothioate
gnanacgggagccggugggtt

SEQ ID NO: 595 - DNA, 21 bp, Artificial Sequence
  Description of Artificial Sequence: Synthetic oligonucleotide
  modified_base (2)..(2): 2'-O-methylcytidine-5'-phosphate
  modified_base (6)..(8): 2'-O-methylcytidine-5'-phosphate
  modified_base (10)..(10): 2'-O-methylcytidine-5'-phosphate
  modified_base (11)..(11): 2'-O-methyluridine-5'-phosphate
  modified_base (15)..(15): 2'-O-methylcytidine-5'-phosphate
  modified_base (18)..(18): 2'-O-methyluridine-5'-phosphate
  modified_base (21)..(21): 2'-deoxy-thymidine-5'-phosphate-phosphorothioate
gnagannnannggangangtt

SEQ ID NO: 596 - DNA, 21 bp, Artificial Sequence
  Description of Artificial Sequence: Synthetic oligonucleotide
  modified_base (1)..(1): 2'-O-methylcytidine-5'-phosphate
  modified_base (8)..(8): 2'-O-methylcytidine-5'-phosphate
  modified_base (21)..(21): 2'-deoxy-thymidine-5'-phosphate-phosphorothioate
naucgucnagugggucugctt

SEQ ID NO: 597 - DNA, 21 bp, Artificial Sequence
  Description of Artificial Sequence: Synthetic oligonucleotide
  modified_base (4)..(4): 2'-O-methylcytidine-5'-phosphate
  modified_base (6)..(6): 2'-O-methylcytidine-5'-phosphate
  modified_base (7)..(7): 2'-O-methyluridine-5'-phosphate
  modified_base (9)..(9): 2'-O-methyluridine-5'-phosphate
  modified_base (12)..(12): 2'-O-methyluridine-5'-phosphate
  modified_base (15)..(15): 2'-O-methylcytidine-5'-phosphate
  modified_base (16)..(16): 2'-O-methyluridine-5'-phosphate
  modified_base (17)..(17): 2'-O-methylcytidine-5'-phosphate
  modified_base (18)..(18): 2'-O-methyluridine-5'-phosphate
  modified_base (21)..(21): 2'-deoxy-thymidine-5'-phosphate-phosphorothioate
aaangnnanggnaannnnatt

SEQ ID NO: 598 - DNA, 21 bp, Artificial Sequence
  Description of Artificial Sequence: Synthetic oligonucleotide
  modified_base (1)..(1): 2'-O-methyluridine-5'-phosphate
  modified_base (7)..(7): 2'-O-methyluridine-5'-phosphate
  modified_base (10)..(10): 2'-O-methylcytidine-5'-phosphate
  modified_base (12)..(12): 2'-O-methyluridine-5'-phosphate
  modified_base (21)..(21): 2'-deoxy-thymidine-5'-phosphate-phosphorothioate
nagagunacnanagcguuutt

SEQ ID NO: 599 - DNA, 21 bp, Artificial Sequence
  Description of Artificial Sequence: Synthetic oligonucleotide
  modified_base (1)..(2): 2'-O-methyluridine-5'-phosphate
  modified_base (3)..(3): 2'-O-methylcytidine-5'-phosphate
  modified_base (5)..(7): 2'-O-methylcytidine-5'-phosphate
  modified_base (10)..(10): 2'-O-methylcytidine-5'-phosphate
  modified_base (11)..(14): 2'-O-methyluridine-5'-phosphate
  modified_base (18)..(19): 2'-O-methylcytidine-5'-phosphate
  modified_base (21)..(21): 2'-deoxy-thymidine-5'-phosphate-phosphorothioate
nnngnnngannnnngaanntt

SEQ ID NO: 600 - DNA, 21 bp, Artificial Sequence
  Description of Artificial Sequence: Synthetic oligonucleotide
  modified_base (5)..(5): 2'-O-methylcytidine-5'-phosphate
  modified_base (21)..(21): 2'-deoxy-thymidine-5'-phosphate-phosphorothioate
gguunaaaagucgggcgaatt

SEQ ID NO: 601 - DNA, 21 bp, Artificial Sequence
  Description of Artificial Sequence: Synthetic oligonucleotide
  modified_base (2)..(2): 2'-O-methylcytidine-5'-phosphate
  modified_base (3)..(3): 2'-O-methyluridine-5'-phosphate
  modified_base (5)..(5): 2'-O-methylcytidine-5'-phosphate
  modified_base (8)..(8): 2'-O-methylcytidine-5'-phosphate
  modified_base (12)..(12): 2'-O-methyluridine-5'-phosphate
  modified_base (14)..(15): 2'-O-methylcytidine-5'-phosphate
  modified_base (21)..(21): 2'-deoxy-thymidine-5'-phosphate-phosphorothioate
gnnanggngaanannagagtt

SEQ ID NO: 602 - DNA, 21 bp, Artificial Sequence
  Description of Artificial Sequence: Synthetic oligonucleotide
  modified_base (7)..(7): 2'-O-methyluridine-5'-phosphate
  modified_base (16)..(16): 2'-O-methyluridine-5'-phosphate
  modified_base (21)..(21): 2'-deoxy-thymidine-5'-phosphate-phosphorothioate
cucuggnauucgccgnagctt

SEQ ID NO: 603 - DNA, 21 bp, Artificial Sequence
  Description of Artificial Sequence: Synthetic oligonucleotide
  modified_base (3)..(3): 2'-O-methylcytidine-5'-phosphate
  modified_base (7)..(7): 2'-O-methyluridine-5'-phosphate
  modified_base (9)..(10): 2'-O-methylcytidine-5'-phosphate
  modified_base (15)..(16): 2'-O-methyluridine-5'-phosphate
  modified_base (18)..(18): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
ggngaanannagagnnanntt

SEQ ID NO: 604 - DNA, 21 bp, Artificial Sequence
  Description of Artificial Sequence: Synthetic oligonucleotide
  modified_base (3)..(3): 2'-O-methyluridine-5'-phosphate
  modified_base (12)..(12): 2'-O-methyluridine-5'-phosphate
  modified_base (21)..(21): 2'-deoxy-thymidine-5'-phosphate-phosphorothioate
agnaacucuggnauucgcctt

SEQ ID NO: 605 - DNA, 21 bp, Artificial Sequence
  Description of Artificial Sequence: Synthetic oligonucleotide
  modified_base (3)..(3): 2'-O-methyluridine-5'-phosphate
  modified_base (6)..(6): 2'-O-methyluridine-5'-phosphate
  modified_base (9)..(9): 2'-O-methylcytidine-5'-phosphate
  modified_base (12)..(13): 2'-O-methylcytidine-5'-phosphate
  modified_base (16)..(16): 2'-O-methyluridine-5'-phosphate
  modified_base (17)..(17): 2'-O-methylcytidine-5'-phosphate
  modified_base (21)..(21): 2'-deoxy-thymidine-5'-phosphate-phosphorothioate
ggnganganaannggnnggtt

SEQ ID NO: 606 - DNA, 21 bp, Artificial Sequence
  Description of Artificial Sequence: Synthetic oligonucleotide
  modified_base (13)..(13): 2'-O-methylcytidine-5'-phosphate
  modified_base (16)..(16): 2'-O-methylcytidine-5'-phosphate
  modified_base (21)..(21): 2'-deoxy-thymidine-5'-phosphate-phosphorothioate
ccgaccgguugunaunacctt

SEQ ID NO: 607 - DNA, 21 bp, Artificial Sequence
  Description of Artificial Sequence: Synthetic oligonucleotide
  modified_base (1)..(1): 2'-O-methyluridine-5'-phosphate
  modified_base (6)..(6): 2'-O-methylcytidine-5'-phosphate
  modified_base (9)..(9): 2'-O-methylcytidine-5'-phosphate
  modified_base (11)..(11): 2'-O-methylcytidine-5'-phosphate
  modified_base (13)..(14): 2'-O-methyluridine-5'-phosphate
  modified_base (16)..(16): 2'-O-methylcytidine-5'-phosphate
  modified_base (21)..(21): 2'-deoxy-thymidine-5'-phosphate-phosphorothioate
nagaanaangnannangagtt

SEQ ID NO: 608 - DNA, 21 bp, Artificial Sequence
  Description of Artificial Sequence: Synthetic oligonucleotide
  modified_base (5)..(5): 2'-O-methyluridine-5'-phosphate
  modified_base (18)..(18): 2'-O-methyluridine-5'-phosphate
  modified_base (21)..(21): 2'-deoxy-thymidine-5'-phosphate-phosphorothioate
cucgnaaugcguuguucnatt

SEQ ID NO: 609 - DNA, 21 bp, Artificial Sequence
  Description of Artificial Sequence: Synthetic oligonucleotide
  modified_base (6)..(7): 2'-O-methylcytidine-5'-phosphate
  modified_base (8)..(8): 2'-O-methyluridine-5'-phosphate
  modified_base (11)..(11): 2'-O-methylcytidine-5'-phosphate
  modified_base (13)..(15): 2'-O-methyluridine-5'-phosphate
  modified_base (16)..(16): 2'-O-methylcytidine-5'-phosphate
  modified_base (19)..(19): 2'-O-methylcytidine-5'-phosphate
  modified_base (21)..(21): 2'-deoxy-thymidine-5'-phosphate-phosphorothioate
ggaaannnganannnnggntt

SEQ ID NO: 610 - DNA, 21 bp, Artificial Sequence
  Description of Artificial Sequence: Synthetic oligonucleotide
  modified_base (11)..(11): 2'-O-methylcytidine-5'-phosphate
  modified_base (21)..(21): 2'-deoxy-thymidine-5'-phosphate-phosphorothioate
gccgaaaugunagguuucctt

SEQ ID NO: 611 - DNA, 21 bp, Artificial Sequence
  Description of Artificial Sequence: Synthetic oligonucleotide
  modified_base (1)..(3): 2'-O-methylcytidine-5'-phosphate
  modified_base (8)..(9): 2'-O-methyluridine-5'-phosphate
  modified_base (12)..(12): 2'-O-methyluridine-5'-phosphate
  modified_base (13)..(13): 2'-O-methylcytidine-5'-phosphate
  modified_base (18)..(19): 2'-O-methyluridine-5'-phosphate
  modified_base (21)..(21): 2'-deoxy-thymidine-5'-phosphate-phosphorothioate
nnnaagannganngaggnntt

SEQ ID NO: 612 - DNA, 21 bp, Artificial Sequence
  Description of Artificial Sequence: Synthetic oligonucleotide
  modified_base (10)..(10): 2'-O-methylcytidine-5'-phosphate
  modified_base (21)..(21): 2'-deoxy-thymidine-5'-phosphate-phosphorothioate
aaccucgaunaaucuugggtt

SEQ ID NO: 613 - DNA, 21 bp, Artificial Sequence
  Description of Artificial Sequence: Synthetic oligonucleotide
  modified_base (5)..(6): 2'-O-methyluridine-5'-phosphate
  modified_base (7)..(8): 2'-O-methylcytidine-5'-phosphate
  modified_base (9)..(9): 2'-O-methyluridine-5'-phosphate
  modified_base (11)..(11): 2'-O-methyluridine-5'-phosphate
  modified_base (15)..(15): 2'-O-methylcytidine-5'-phosphate
  modified_base (18)..(18): 2'-O-methylcytidine-5'-phosphate
  modified_base (21)..(21): 2'-deoxy-thymidine-5'-phosphate-phosphorothioate
agaannnnngnaagnganatt

SEQ ID NO: 614 - DNA, 21 bp, Artificial Sequence
  Description of Artificial Sequence: Synthetic oligonucleotide
  modified_base (8)..(8): 2'-O-methyluridine-5'-phosphate
  modified_base (10)..(10): 2'-O-methylcytidine-5'-phosphate
  modified_base (21)..(21): 2'-deoxy-thymidine-5'-phosphate-phosphorothioate
ugucgcunanaggaauucutt

SEQ ID NO: 615 - DNA, 21 bp, Artificial Sequence
  Description of Artificial Sequence: Synthetic oligonucleotide
  modified_base (2)..(2): 2'-O-methyluridine-5'-phosphate
  modified_base (3)..(4): 2'-O-methylcytidine-5'-phosphate
  modified_base (9)..(10): 2'-O-methyluridine-5'-phosphate
  modified_base (12)..(12): 2'-O-methyluridine-5'-phosphate
  modified_base (14)..(14): 2'-O-methylcytidine-5'-phosphate
  modified_base (15)..(15): 2'-O-methyluridine-5'-phosphate
  modified_base (17)..(17): 2'-O-methylcytidine-5'-phosphate
  modified_base (19)..(19): 2'-O-methylcytidine-5'-phosphate
  modified_base (21)..(21): 2'-deoxy-thymidine-5'-phosphate-phosphorothioate
annnaggannangnnangntt

SEQ ID NO: 616 - DNA, 21 bp, Artificial Sequence
  Description of Artificial Sequence: Synthetic oligonucleotide
  modified_base (4)..(4): 2'-O-methyluridine-5'-phosphate
  modified_base (7)..(7): 2'-O-methylcytidine-5'-phosphate
  modified_base (9)..(9): 2'-O-methyluridine-5'-phosphate
  modified_base (21)..(21): 2'-deoxy-thymidine-5'-phosphate-phosphorothioate
gcgnagnanaauccuggautt

SEQ ID NO: 617 - DNA, 21 bp, Artificial Sequence
  Description of Artificial Sequence: Synthetic oligonucleotide
  modified_base (1)..(1): 2'-O-methyluridine-5'-phosphate
  modified_base (2)..(3): 2'-O-methylcytidine-5'-phosphate
  modified_base (8)..(9): 2'-O-methyluridine-5'-phosphate
  modified_base (11)..(11): 2'-O-methyluridine-5'-phosphate
  modified_base (13)..(13): 2'-O-methylcytidine-5'-phosphate
  modified_base (14)..(14): 2'-O-methyluridine-5'-phosphate
  modified_base (16)..(16): 2'-O-methylcytidine-5'-phosphate
  modified_base (18)..(18): 2'-O-methylcytidine-5'-phosphate
  modified_base (21)..(21): 2'-deoxy-thymidine-5'-phosphate-phosphorothioate
nnnaggannangnnangnatt

SEQ ID NO: 618 - DNA, 21 bp, Artificial Sequence
  Description of Artificial Sequence: Synthetic oligonucleotide
  modified_base (5)..(5): 2'-O-methyluridine-5'-phosphate
  modified_base (8)..(8): 2'-O-methylcytidine-5'-phosphate
  modified_base (10)..(10): 2'-O-methyluridine-5'-phosphate
  modified_base (21)..(21): 2'-deoxy-thymidine-5'-phosphate-phosphorothioate
ugcgnagnanaauccuggatt

SEQ ID NO: 619 - DNA, 21 bp, Artificial Sequence
  Description of Artificial Sequence: Synthetic oligonucleotide
  modified_base (1)..(2): 2'-O-methylcytidine-5'-phosphate
  modified_base (6)..(8): 2'-O-methylcytidine-5'-phosphate
  modified_base (14)..(14): 2'-O-methylcytidine-5'-phosphate
  modified_base (16)..(16): 2'-O-methylcytidine-5'-phosphate
  modified_base (18)..(18): 2'-O-methylcytidine-5'-phosphate
  modified_base (21)..(21): 2'-deoxy-thymidine-5'-phosphate-phosphorothioate
nnaaannngaagangngnatt

SEQ ID NO: 620 - DNA, 21 bp, Artificial Sequence
  Description of Artificial Sequence: Synthetic oligonucleotide
  modified_base (1)..(1): 2'-O-methyluridine-5'-phosphate
  modified_base (9)..(9): 2'-O-methyluridine-5'-phosphate
  modified_base (15)..(17): 2'-O-methyluridine-5'-phosphate
  modified_base (21)..(21): 2'-deoxy-thymidine-5'-phosphate-phosphorothioate
ngcgcgucnucgggnnnggtt

SEQ ID NO: 621 - DNA, 21 bp, Artificial Sequence
  Description of Artificial Sequence: Synthetic oligonucleotide
  modified_base (2)..(4): 2'-O-methylcytidine-5'-phosphate
  modified_base (8)..(8): 2'-O-methylcytidine-5'-phosphate
  modified_base (12)..(14): 2'-O-methylcytidine-5'-phosphate
  modified_base (17)..(19): 2'-O-methyluridine-5'-phosphate
  modified_base (21)..(21): 2'-deoxy-thymidine-5'-phosphate-phosphorothioate
annnaaanggannnaannntt

SEQ ID NO: 622 - DNA, 21 bp, Artificial Sequence
  Description of Artificial Sequence: Synthetic oligonucleotide
  modified_base (4)..(5): 2'-O-methyluridine-5'-phosphate
  modified_base (13)..(15): 2'-O-methyluridine-5'-phosphate
  modified_base (21)..(21): 2'-deoxy-thymidine-5'-phosphate-phosphorothioate
aaannggguccgnnngggutt

SEQ ID NO: 623 - DNA, 21 bp, Artificial Sequence
  Description of Artificial Sequence: Synthetic oligonucleotide
  modified_base (3)..(3): 2'-O-methylcytidine-5'-phosphate
  modified_base (7)..(9): 2'-O-methylcytidine-5'-phosphate
  modified_base (12)..(14): 2'-O-methyluridine-5'-phosphate
  modified_base (16)..(16): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
aanggannnaannngnaantt

SEQ ID NO: 624 - DNA, 21 bp, Artificial Sequence
  Description of Artificial Sequence: Synthetic oligonucleotide
  modified_base (5)..(5): 2'-O-methylcytidine-5'-phosphate
  modified_base (21)..(21): 2'-deoxy-thymidine-5'-phosphate-phosphorothioate
auugnaaauuggguccguutt

SEQ ID NO: 625 - DNA, 21 bp, Artificial Sequence
  Description of Artificial Sequence: Synthetic oligonucleotide
  modified_base (1)..(1): 2'-O-methylcytidine-5'-phosphate
  modified_base (3)..(4): 2'-O-methyluridine-5'-phosphate
  modified_base (9)..(9): 2'-O-methylcytidine-5'-phosphate
  modified_base (12)..(12): 2'-O-methylcytidine-5'-phosphate
  modified_base (14)..(14): 2'-O-methylcytidine-5'-phosphate
  modified_base (16)..(17): 2'-O-methyluridine-5'-phosphate
  modified_base (19)..(19): 2'-O-methylcytidine-5'-phosphate
  modified_base (21)..(21): 2'-deoxy-thymidine-5'-phosphate-phosphorothioate
nannagaanaangnannantt

SEQ ID NO: 626 - DNA, 21 bp, Artificial Sequence
  Description of Artificial Sequence: Synthetic oligonucleotide
  modified_base (2)..(2): 2'-O-methyluridine-5'-phosphate
  modified_base (15)..(15): 2'-O-methyluridine-5'-phosphate
  modified_base (21)..(21): 2'-deoxy-thymidine-5'-phosphate-phosphorothioate
gnaaugcguuguucnaaugtt

SEQ ID NO: 627 - DNA, 21 bp, Artificial Sequence
  Description of Artificial Sequence: Synthetic oligonucleotide
  modified_base (2)..(3): 2'-O-methyluridine-5'-phosphate
  modified_base (8)..(8): 2'-O-methylcytidine-5'-phosphate
  modified_base (11)..(11): 2'-O-methylcytidine-5'-phosphate
  modified_base (13)..(13): 2'-O-methylcytidine-5'-phosphate
  modified_base (15)..(16): 2'-O-methyluridine-5'-phosphate
  modified_base (18)..(18): 2'-O-methylcytidine-5'-phosphate
  modified_base (21)..(21): 2'-deoxy-thymidine-5'-phosphate-phosphorothioate
annagaanaangnannangtt

SEQ ID NO: 628 - DNA, 21 bp, Artificial Sequence
  Description of Artificial Sequence: Synthetic oligonucleotide
  modified_base (3)..(3): 2'-O-methyluridine-5'-phosphate
  modified_base (16)..(16): 2'-O-methyluridine-5'-phosphate
  modified_base (21)..(21): 2'-deoxy-thymidine-5'-phosphate-phosphorothioate
cgnaaugcguuguucnaautt

SEQ ID NO: 629 - DNA, 21 bp, Artificial Sequence
  Description of Artificial Sequence: Synthetic oligonucleotide
  modified_base (1)..(1): 2'-O-methyluridine-5'-phosphate
  modified_base (7)..(7): 2'-O-methyluridine-5'-phosphate
  modified_base (10)..(10): 2'-O-methyluridine-5'-phosphate
  modified_base (11)..(11): 2'-O-methylcytidine-5'-phosphate
  modified_base (12)..(12): 2'-O-methyluridine-5'-phosphate
  modified_base (17)..(18): 2'-O-methylcytidine-5'-phosphate
  modified_base (21)..(21): 2'-deoxy-thymidine-5'-phosphate-phosphorothioate
ngagaanggnnnaaagnnatt

SEQ ID NO: 630 - DNA, 21 bp, Artificial Sequence
  Description of Artificial Sequence: Synthetic oligonucleotide
  modified_base (7)..(7): 2'-O-methyluridine-5'-phosphate
  modified_base (12)..(12): 2'-O-methylcytidine-5'-phosphate
  modified_base (18)..(18): 2'-O-methylcytidine-5'-phosphate
  modified_base (21)..(21): 2'-deoxy-thymidine-5'-phosphate-phosphorothioate
uggcuunagacnauucunatt

SEQ ID NO: 631 - DNA, 21 bp, Artificial Sequence
  Description of Artificial Sequence: Synthetic oligonucleotide
  modified_base (4)..(4): 2'-O-methylcytidine-5'-phosphate
  modified_base (5)..(6): 2'-O-methyluridine-5'-phosphate
  modified_base (8)..(9): 2'-O-methyluridine-5'-phosphate
  modified_base (13)..(14): 2'-O-methylcytidine-5'-phosphate
  modified_base (18)..(18): 2'-O-methylcytidine-5'-phosphate
  modified_base (21)..(21): 2'-deoxy-thymidine-5'-phosphate-phosphorothioate
aggnnnanngggnngaanatt

SEQ ID NO: 632 - DNA, 21 bp, Artificial Sequence
  Description of Artificial Sequence: Synthetic oligonucleotide
  modified_base (10)..(10): 2'-O-methylcytidine-5'-phosphate
  modified_base (13)..(13): 2'-O-methyluridine-5'-phosphate
  modified_base (21)..(21): 2'-deoxy-thymidine-5'-phosphate-phosphorothioate
uguucggccnaanaagccutt

SEQ ID NO: 633 - DNA, 21 bp, Artificial Sequence
  Description of Artificial Sequence: Synthetic oligonucleotide
  modified_base (1)..(1): 2'-O-methyluridine-5'-phosphate
  modified_base (2)..(2): 2'-O-methylcytidine-5'-phosphate
  modified_base (4)..(5): 2'-O-methyluridine-5'-phosphate
  modified_base (10)..(10): 2'-O-methylcytidine-5'-phosphate
  modified_base (13)..(13): 2'-O-methylcytidine-5'-phosphate
  modified_base (15)..(15): 2'-O-methylcytidine-5'-phosphate
  modified_base (17)..(18): 2'-O-methyluridine-5'-phosphate
  modified_base (21)..(21): 2'-deoxy-thymidine-5'-phosphate-phosphorothioate
nnannagaanaangnannatt

SEQ ID NO: 634 - DNA, 21 bp, Artificial Sequence
  Description of Artificial Sequence: Synthetic oligonucleotide
  modified_base (1)..(1): 2'-O-methyluridine-5'-phosphate
  modified_base (14)..(14): 2'-O-methyluridine-5'-phosphate
  modified_base (21)..(21): 2'-deoxy-thymidine-5'-phosphate-phosphorothioate
naaugcguuguucnaaugatt

SEQ ID NO: 635 - DNA, 21 bp, Artificial Sequence
  Description of Artificial Sequence: Synthetic oligonucleotide
  modified_base (1)..(2): 2'-O-methyluridine-5'-phosphate
  modified_base (6)..(7): 2'-O-methylcytidine-5'-phosphate
  modified_base (11)..(11): 2'-O-methylcytidine-5'-phosphate
  modified_base (13)..(13): 2'-O-methyluridine-5'-phosphate
  modified_base (16)..(16): 2'-O-methyluridine-5'-phosphate
  modified_base (17)..(17): 2'-O-methylcytidine-5'-phosphate
  modified_base (21)..(21): 2'-deoxy-thymidine-5'-phosphate-phosphorothioate
nngggnngaananggnnaatt

SEQ ID NO: 636 - DNA, 21 bp, Artificial Sequence
  Description of Artificial Sequence: Synthetic oligonucleotide
  modified_base (6)..(6): 2'-O-methylcytidine-5'-phosphate
  modified_base (17)..(17): 2'-O-methylcytidine-5'-phosphate
  modified_base (21)..(21): 2'-deoxy-thymidine-5'-phosphate-phosphorothioate
uugacnauguucggccnaatt

SEQ ID NO: 637 - DNA, 21 bp, Artificial Sequence
  Description of Artificial Sequence: Synthetic oligonucleotide
  modified_base (1)..(1): 2'-O-methylcytidine-5'-phosphate
  modified_base (3)..(3): 2'-O-methylcytidine-5'-phosphate
  modified_base (5)..(5): 2'-O-methyluridine-5'-phosphate
  modified_base (6)..(7): 2'-O-methylcytidine-5'-phosphate
  modified_base (9)..(9): 2'-O-methylcytidine-5'-phosphate
  modified_base (10)..(10): 2'-O-methyluridine-5'-phosphate
  modified_base (11)..(11): 2'-O-methylcytidine-5'-phosphate
  modified_base (12)..(12): 2'-O-methyluridine-5'-phosphate
  modified_base (13)..(13): 2'-O-methylcytidine-5'-phosphate
  modified_base (18)..(18): 2'-O-methyluridine-5'-phosphate
  modified_base (21)..(21): 2'-deoxy-thymidine-5'-phosphate-phosphorothioate
nanannngnnnnngaggngtt

SEQ ID NO: 638 - DNA, 21 bp, Artificial Sequence
  Description of Artificial Sequence: Synthetic oligonucleotide
  modified_base (1)..(1): 2'-O-methylcytidine-5'-phosphate
  modified_base (21)..(21): 2'-deoxy-thymidine-5'-phosphate-phosphorothioate
naccucgagagcggaugugtt

SEQ ID NO: 639 - DNA, 21 bp, Artificial Sequence
  Description of Artificial Sequence: Synthetic oligonucleotide
  modified_base (4)..(4): 2'-O-methylcytidine-5'-phosphate
  modified_base (8)..(10): 2'-O-methylcytidine-5'-phosphate
  modified_base (13)..(15): 2'-O-methyluridine-5'-phosphate
  modified_base (17)..(17): 2'-O-methylcytidine-5'-phosphate
  modified_base (21)..(21): 2'-deoxy-thymidine-5'-phosphate-phosphorothioate
aaanggannnaannngnaatt

SEQ ID NO: 640 - DNA, 21 bp, Artificial Sequence
  Description of Artificial Sequence: Synthetic oligonucleotide
  modified_base (4)..(4): 2'-O-methylcytidine-5'-phosphate
  modified_base (21)..(21): 2'-deoxy-thymidine-5'-phosphate-phosphorothioate
uugnaaauuggguccguuutt

SEQ ID NO: 641 - DNA, 21 bp, Artificial Sequence
  Description of Artificial Sequence: Synthetic oligonucleotide
  modified_base (3)..(3): 2'-O-methylcytidine-5'-phosphate
  modified_base (6)..(6): 2'-O-methylcytidine-5'-phosphate
  modified_base (8)..(8): 2'-O-methylcytidine-5'-phosphate
  modified_base (10)..(11): 2'-O-methyluridine-5'-phosphate
  modified_base (13)..(13): 2'-O-methylcytidine-5'-phosphate
  modified_base (17)..(17): 2'-O-methyluridine-5'-phosphate
  modified_base (18)..(18): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
aanaangnannangagnnntt

SEQ ID NO: 642 - DNA, 21 bp, Artificial Sequence
  Description of Artificial Sequence: Synthetic oligonucleotide
  modified_base (8)..(8): 2'-O-methyluridine-5'-phosphate
  modified_base (21)..(21): 2'-deoxy-thymidine-5'-phosphate-phosphorothioate
agacucgnaaugcguuguutt

SEQ ID NO: 643 - DNA, 21 bp, Artificial Sequence
  Description of Artificial Sequence: Synthetic oligonucleotide
  modified_base (4)..(4): 2'-O-methylcytidine-5'-phosphate
  modified_base (7)..(7): 2'-O-methylcytidine-5'-phosphate
  modified_base (9)..(9): 2'-O-methylcytidine-5'-phosphate
  modified_base (11)..(12): 2'-O-methyluridine-5'-phosphate
  modified_base (14)..(14): 2'-O-methylcytidine-5'-phosphate
  modified_base (18)..(18): 2'-O-methyluridine-5'-phosphate
  modified_base (19)..(19): 2'-O-methylcytidine-5'-phosphate
  modified_base (21)..(21): 2'-deoxy-thymidine-5'-phosphate-phosphorothioate
gaanaangnannangagnntt

SEQ ID NO: 644 - DNA, 21 bp, Artificial Sequence
  Description of Artificial Sequence: Synthetic oligonucleotide
  modified_base (7)..(7): 2'-O-methyluridine-5'-phosphate
  modified_base (21)..(21): 2'-deoxy-thymidine-5'-phosphate-phosphorothioate
gacucgnaaugcguuguuctt

SEQ ID NO: 645 - DNA, 21 bp, Artificial Sequence
  Description of Artificial Sequence: Synthetic oligonucleotide
  modified_base (2)..(3): 2'-O-methylcytidine-5'-phosphate
  modified_base (5)..(5): 2'-O-methylcytidine-5'-phosphate
  modified_base (8)..(8): 2'-O-methylcytidine-5'-phosphate
  modified_base (9)..(9): 2'-O-methyluridine-5'-phosphate
  modified_base (10)..(10): 2'-O-methylcytidine-5'-phosphate
  modified_base (15)..(15): 2'-O-methylcytidine-5'-phosphate
  modified_base (18)..(18): 2'-O-methylcytidine-5'-phosphate
  modified_base (21)..(21): 2'-deoxy-thymidine-5'-phosphate-phosphorothioate
gnnangannnaaaanganatt

SEQ ID NO: 646 - DNA, 21 bp, Artificial Sequence
  Description of Artificial Sequence: Synthetic oligonucleotide
  modified_base (21)..(21): 2'-deoxy-thymidine-5'-phosphate-phosphorothioate
ugucguuuugagucguggctt

SEQ ID NO: 647 - DNA, 21 bp, Artificial Sequence
  Description of Artificial Sequence: Synthetic oligonucleotide
  modified_base (1)..(2): 2'-O-methylcytidine-5'-phosphate
  modified_base (4)..(4): 2'-O-methylcytidine-5'-phosphate
  modified_base (8)..(8): 2'-O-methylcytidine-5'-phosphate
  modified_base (9)..(9): 2'-O-methyluridine-5'-phosphate
  modified_base (12)..(13): 2'-O-methylcytidine-5'-phosphate
  modified_base (16)..(16): 2'-O-methyluridine-5'-phosphate
  modified_base (21)..(21): 2'-deoxy-thymidine-5'-phosphate-phosphorothioate
nnanaagnngannggnaagtt

SEQ ID NO: 648 - DNA, 21 bp, Artificial Sequence
  Description of Artificial Sequence: Synthetic oligonucleotide
  modified_base (3)..(3): 2'-O-methyluridine-5'-phosphate
  modified_base (10)..(10): 2'-O-methylcytidine-5'-phosphate
  modified_base (21)..(21): 2'-deoxy-thymidine-5'-phosphate-phosphorothioate
cunaccggunagcuuguggtt

SEQ ID NO: 649 - DNA, 21 bp, Artificial Sequence
  Description of Artificial Sequence: Synthetic oligonucleotide
  modified_base (1)..(1): 2'-O-methyluridine-5'-phosphate
  modified_base (2)..(3): 2'-O-methylcytidine-5'-phosphate
  modified_base (5)..(5): 2'-O-methylcytidine-5'-phosphate
  modified_base (9)..(9): 2'-O-methylcytidine-5'-phosphate
  modified_base (10)..(10): 2'-O-methyluridine-5'-phosphate
  modified_base (13)..(14): 2'-O-methylcytidine-5'-phosphate
  modified_base (17)..(17): 2'-O-methyluridine-5'-phosphate
  modified_base (21)..(21): 2'-deoxy-thymidine-5'-phosphate-phosphorothioate
nnnanaagnngannggnaatt

SEQ ID NO: 650 - DNA, 21 bp, Artificial Sequence
  Description of Artificial Sequence: Synthetic oligonucleotide
  modified_base (2)..(2): 2'-O-methyluridine-5'-phosphate
  modified_base (9)..(9): 2'-O-methylcytidine-5'-phosphate
  modified_base (21)..(21): 2'-deoxy-thymidine-5'-phosphate-phosphorothioate
unaccggunagcuuguggatt

SEQ ID NO: 651 - DNA, 21 bp, Artificial Sequence
  Description of Artificial Sequence: Synthetic oligonucleotide
  modified_base (1)..(1): 2'-O-methyluridine-5'-phosphate
  modified_base (5)..(5): 2'-O-methyluridine-5'-phosphate
  modified_base (7)..(7): 2'-O-methyluridine-5'-phosphate
  modified_base (8)..(8): 2'-O-methylcytidine-5'-phosphate
  modified_base (10)..(10): 2'-O-methyluridine-5'-phosphate
  modified_base (12)..(12): 2'-O-methyluridine-5'-phosphate
  modified_base (13)..(13): 2'-O-methylcytidine-5'-phosphate
  modified_base (17)..(19): 2'-O-methylcytidine-5'-phosphate
  modified_base (21)..(21): 2'-deoxy-thymidine-5'-phosphate-phosphorothioate
ngaangnnananngggnnntt

SEQ ID NO: 652 - DNA, 21 bp, Artificial Sequence
  Description of Artificial Sequence: Synthetic oligonucleotide
  modified_base (9)..(9): 2'-O-methyluridine-5'-phosphate
  modified_base (14)..(14): 2'-O-methylcytidine-5'-phosphate
  modified_base (18)..(18): 2'-O-methylcytidine-5'-phosphate
  modified_base (21)..(21): 2'-deoxy-thymidine-5'-phosphate-phosphorothioate
gggcccganauganauunatt

SEQ ID NO: 653 - DNA, 21 bp, Artificial Sequence
  Description of Artificial Sequence: Synthetic oligonucleotide
  modified_base (2)..(2): 2'-O-methylcytidine-5'-phosphate
  modified_base (3)..(3): 2'-O-methyluridine-5'-phosphate
  modified_base (5)..(5): 2'-O-methyluridine-5'-phosphate
  modified_base (6)..(6): 2'-O-methylcytidine-5'-phosphate
  modified_base (8)..(10): 2'-O-methylcytidine-5'-phosphate
  modified_base (12)..(14): 2'-O-methyluridine-5'-phosphate
  modified_base (15)..(15): 2'-O-methylcytidine-5'-phosphate
  modified_base (18)..(18): 2'-O-methylcytidine-5'-phosphate
  modified_base (21)..(21): 2'-deoxy-thymidine-5'-phosphate-phosphorothioate
annannannnannnnggnatt

SEQ ID NO: 654 - DNA, 21 bp, Artificial Sequence
  Description of Artificial Sequence: Synthetic oligonucleotide
  modified_base (16)..(16): 2'-O-methyluridine-5'-phosphate
  modified_base (21)..(21): 2'-deoxy-thymidine-5'-phosphate-phosphorothioate
ugccgaaauggguganagutt

SEQ ID NO: 655 - DNA, 21 bp, Artificial Sequence
  Description of Artificial Sequence: Synthetic oligonucleotide
  modified_base (3)..(4): 2'-O-methylcytidine-5'-phosphate
  modified_base (7)..(7): 2'-O-methyluridine-5'-phosphate
  modified_base (10)..(10): 2'-O-methylcytidine-5'-phosphate
  modified_base (12)..(12): 2'-O-methylcytidine-5'-phosphate
  modified_base (13)..(13): 2'-O-methyluridine-5'-phosphate
  modified_base (14)..(15): 2'-O-methylcytidine-5'-phosphate
  modified_base (18)..(18): 2'-O-methylcytidine-5'-phosphate
  modified_base (21)..(21): 2'-deoxy-thymidine-5'-phosphate-phosphorothioate
gannganganannnnaanatt

SEQ ID NO: 656 - DNA, 21 bp, Artificial Sequence
  Description of Artificial Sequence: Synthetic oligonucleotide
  modified_base (12)..(12): 2'-O-methylcytidine-5'-phosphate
  modified_base (21)..(21): 2'-deoxy-thymidine-5'-phosphate-phosphorothioate
uguuggagugunaucgguctt

SEQ ID NO: 657 - DNA, 21 bp, Artificial Sequence
  Description of Artificial Sequence: Synthetic oligonucleotide
  modified_base (3)..(3): 2'-O-methylcytidine-5'-phosphate
  modified_base (5)..(6): 2'-O-methylcytidine-5'-phosphate
  modified_base (11)..(11): 2'-O-methyluridine-5'-phosphate
  modified_base (12)..(12): 2'-O-methylcytidine-5'-phosphate
  modified_base (15)..(15): 2'-O-methyluridine-5'-phosphate
  modified_base (16)..(16): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
ganannggagnnagnnaantt

SEQ ID NO: 658 - DNA, 21 bp, Artificial Sequence
  Description of Artificial Sequence: Synthetic oligonucleotide
  modified_base (2)..(3): 2'-O-methyluridine-5'-phosphate
  modified_base (7)..(7): 2'-O-methyluridine-5'-phosphate
  modified_base (16)..(16): 2'-O-methyluridine-5'-phosphate
  modified_base (21)..(21): 2'-deoxy-thymidine-5'-phosphate-phosphorothioate
anngacngacuccggnguctt

SEQ ID NO: 659 - DNA, 21 bp, Artificial Sequence
  Description of Artificial Sequence: Synthetic oligonucleotide
  modified_base (2)..(3): 2'-O-methylcytidine-5'-phosphate
  modified_base (8)..(8): 2'-O-methyluridine-5'-phosphate
  modified_base (9)..(9): 2'-O-methylcytidine-5'-phosphate
  modified_base (12)..(12): 2'-O-methyluridine-5'-phosphate
  modified_base (13)..(13): 2'-O-methylcytidine-5'-phosphate
  modified_base (16)..(16): 2'-O-methyluridine-5'-phosphate
  modified_base (21)..(21): 2'-deoxy-thymidine-5'-phosphate-phosphorothioate
annggagnnagnnaangggtt

SEQ ID NO: 660 - DNA, 21 bp, Artificial Sequence
  Description of Artificial Sequence: Synthetic oligonucleotide
  modified_base (3)..(3): 2'-O-methylcytidine-5'-phosphate
  modified_base (21)..(21): 2'-deoxy-thymidine-5'-phosphate-phosphorothioate
ccnauugacugacuccggutt

SEQ ID NO: 661 - DNA, 21 bp, Artificial Sequence
  Description of Artificial Sequence: Synthetic oligonucleotide
  modified_base (1)..(2): 2'-O-methylcytidine-5'-phosphate
  modified_base (7)..(7): 2'-O-methyluridine-5'-phosphate
  modified_base (8)..(8): 2'-O-methylcytidine-5'-phosphate
  modified_base (11)..(11): 2'-O-methyluridine-5'-phosphate
  modified_base (12)..(12): 2'-O-methylcytidine-5'-phosphate
  modified_base (15)..(15): 2'-O-methyluridine-5'-phosphate
  modified_base (21)..(21): 2'-deoxy-thymidine-5'-phosphate-phosphorothioate
nnggagnnagnnaanggggtt

SEQ ID NO: 662 - DNA, 21 bp, Artificial Sequence
  Description of Artificial Sequence: Synthetic oligonucleotide
  modified_base (4)..(4): 2'-O-methylcytidine-5'-phosphate
  modified_base (21)..(21): 2'-deoxy-thymidine-5'-phosphate-phosphorothioate
cccnauugacugacuccggtt

SEQ ID NO: 663 - DNA, 21 bp, Artificial Sequence
  Description of Artificial Sequence: Synthetic oligonucleotide
  modified_base (2)..(2): 2'-O-methylcytidine-5'-phosphate
  modified_base (3)..(3): 2'-O-methyluridine-5'-phosphate
  modified_base (4)..(5): 2'-O-methylcytidine-5'-phosphate
  modified_base (7)..(7): 2'-O-methyluridine-5'-phosphate
  modified_base (8)..(8): 2'-O-methylcytidine-5'-phosphate
  modified_base (12)..(12): 2'-O-methyluridine-5'-phosphate
  modified_base (13)..(14): 2'-O-methylcytidine-5'-phosphate
  modified_base (16)..(16): 2'-O-methylcytidine-5'-phosphate
  modified_base (17)..(17): 2'-O-methyluridine-5'-phosphate
  modified_base (18)..(18): 2'-O-methylcytidine-5'-phosphate
  modified_base (21)..(21): 2'-deoxy-thymidine-5'-phosphate-phosphorothioate
annnnanngaannnannnatt

SEQ ID NO: 664 - DNA, 21 bp, Artificial Sequence
  Description of Artificial Sequence: Synthetic oligonucleotide
  modified_base (1)..(1): 2'-O-methyluridine-5'-phosphate
  modified_base (5)..(5): 2'-O-methyluridine-5'-phosphate
  modified_base (9)..(9): 2'-O-methyluridine-5'-phosphate
  modified_base (14)..(14): 2'-O-methyluridine-5'-phosphate
  modified_base (21)..(21): 2'-deoxy-thymidine-5'-phosphate-phosphorothioate
ngagngganucganggagutt

SEQ ID NO: 665 - DNA, 21 bp, Artificial Sequence
  Description of Artificial Sequence: Synthetic oligonucleotide
  modified_base (1)..(1): 2'-O-methyluridine-5'-phosphate
  modified_base (3)..(3): 2'-O-methyluridine-5'-phosphate
  modified_base (4)..(4): 2'-O-methylcytidine-5'-phosphate
  modified_base (6)..(6): 2'-O-methylcytidine-5'-phosphate
  modified_base (7)..(7): 2'-O-methyluridine-5'-phosphate
  modified_base (10)..(10): 2'-O-methyluridine-5'-phosphate
  modified_base (11)..(11): 2'-O-methylcytidine-5'-phosphate
  modified_base (18)..(19): 2'-O-methylcytidine-5'-phosphate
  modified_base (21)..(21): 2'-deoxy-thymidine-5'-phosphate-phosphorothioate
ngnngnngannaaaaganntt

SEQ ID NO: 666 - DNA, 21 bp, Artificial Sequence
  Description of Artificial Sequence: Synthetic oligonucleotide
  modified_base (12)..(12): 2'-O-methylcytidine-5'-phosphate
  modified_base (18)..(18): 2'-O-methylcytidine-5'-phosphate
  modified_base (21)..(21): 2'-deoxy-thymidine-5'-phosphate-phosphorothioate
ggucuuuugaunagcganatt

SEQ ID NO: 667 - DNA, 21 bp, Artificial Sequence
  Description of Artificial Sequence: Synthetic oligonucleotide
  modified_base (3)..(3): 2'-O-methyluridine-5'-phosphate
  modified_base (4)..(5): 2'-O-methylcytidine-5'-phosphate
  modified_base (8)..(8): 2'-O-methylcytidine-5'-phosphate
  modified_base (9)..(9): 2'-O-methyluridine-5'-phosphate
  modified_base (11)..(14): 2'-O-methylcytidine-5'-phosphate
  modified_base (17)..(17): 2'-O-methyluridine-5'-phosphate
  modified_base (19)..(19): 2'-O-methyluridine-5'-phosphate
  modified_base (21)..(21): 2'-deoxy-thymidine-5'-phosphate-phosphorothioate
agnnnaannannnnagnantt

SEQ ID NO: 668 - DNA, 21 bp, Artificial Sequence
  Description of Artificial Sequence: Synthetic oligonucleotide
  modified_base (2)..(2): 2'-O-methyluridine-5'-phosphate
  modified_base (10)..(10): 2'-O-methyluridine-5'-phosphate
  modified_base (21)..(21): 2'-deoxy-thymidine-5'-phosphate-phosphorothioate
anacuggggnaguuggacutt

SEQ ID NO: 669 - DNA, 21 bp, Artificial Sequence
  Description of Artificial Sequence: Synthetic oligonucleotide
  modified_base (1)..(1): 2'-O-methyluridine-5'-phosphate
  modified_base (4)..(4): 2'-O-methyluridine-5'-phosphate
  modified_base (5)..(5): 2'-O-methylcytidine-5'-phosphate
  modified_base (7)..(9): 2'-O-methylcytidine-5'-phosphate
  modified_base (12)..(13): 2'-O-methylcytidine-5'-phosphate
  modified_base (15)..(15): 2'-O-methylcytidine-5'-phosphate
  modified_base (16)..(16): 2'-O-methyluridine-5'-phosphate
  modified_base (18)..(19): 2'-O-methylcytidine-5'-phosphate
  modified_base (21)..(21): 2'-deoxy-thymidine-5'-phosphate-phosphorothioate
ngannannnaannanngnntt

SEQ ID NO: 670 - DNA, 21 bp, Artificial Sequence
  Description of Artificial Sequence: Synthetic oligonucleotide
  modified_base (3)..(3): 2'-O-methylcytidine-5'-phosphate
  modified_base (18)..(18): 2'-O-methylcytidine-5'-phosphate
  modified_base (21)..(21): 2'-deoxy-thymidine-5'-phosphate-phosphorothioate
ggnagugguugggugaunatt

SEQ ID NO: 671 - DNA, 21 bp, Artificial Sequence
  Description of Artificial Sequence: Synthetic oligonucleotide
  modified_base (1)..(1): 2'-O-methyluridine-5'-phosphate
  modified_base (5)..(6): 2'-O-methylcytidine-5'-phosphate
  modified_base (9)..(9): 2'-O-methyluridine-5'-phosphate
  modified_base (12)..(12): 2'-O-methylcytidine-5'-phosphate
  modified_base (14)..(14): 2'-O-methylcytidine-5'-phosphate
  modified_base (15)..(15): 2'-O-methyluridine-5'-phosphate
  modified_base (16)..(17): 2'-O-methylcytidine-5'-phosphate
  modified_base (21)..(21): 2'-deoxy-thymidine-5'-phosphate-phosphorothioate
nggannganganannnnaatt

SEQ ID NO: 672 - DNA, 21 bp, Artificial Sequence
  Description of Artificial Sequence: Synthetic oligonucleotide
  modified_base (10)..(10): 2'-O-methylcytidine-5'-phosphate
  modified_base (18)..(18): 2'-O-methylcytidine-5'-phosphate
  modified_base (21)..(21): 2'-deoxy-thymidine-5'-phosphate-phosphorothioate
uuggagugunaucggucnatt

SEQ ID NO: 673 - DNA, 21 bp, Artificial Sequence
  Description of Artificial Sequence: Synthetic oligonucleotide
  modified_base (2)..(3): 2'-O-methylcytidine-5'-phosphate
  modified_base (6)..(6): 2'-O-methyluridine-5'-phosphate
  modified_base (9)..(9): 2'-O-methylcytidine-5'-phosphate
  modified_base (11)..(11): 2'-O-methylcytidine-5'-phosphate
  modified_base (12)..(12): 2'-O-methyluridine-5'-phosphate
  modified_base (13)..(14): 2'-O-methylcytidine-5'-phosphate
  modified_base (17)..(17): 2'-O-methylcytidine-5'-phosphate
  modified_base (21)..(21): 2'-deoxy-thymidine-5'-phosphate-phosphorothioate
annganganannnnaanagtt

SEQ ID NO: 674 - DNA, 21 bp, Artificial Sequence
  Description of Artificial Sequence: Synthetic oligonucleotide
  modified_base (13)..(13): 2'-O-methylcytidine-5'-phosphate
  modified_base (21)..(21): 2'-deoxy-thymidine-5'-phosphate-phosphorothioate
cuguuggagugunaucggutt

SEQ ID NO: 675 - DNA, 21 bp, Artificial Sequence
  Description of Artificial Sequence: Synthetic oligonucleotide
  modified_base (1)..(1): 2'-O-methyluridine-5'-phosphate
  modified_base (5)..(5): 2'-O-methylcytidine-5'-phosphate
  modified_base (8)..(9): 2'-O-methylcytidine-5'-phosphate
  modified_base (12)..(12): 2'-O-methyluridine-5'-phosphate
  modified_base (13)..(13): 2'-O-methylcytidine-5'-phosphate
  modified_base (15)..(15): 2'-O-methyluridine-5'-phosphate
  modified_base (16)..(18): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
ngganaannaannannnnntt

SEQ ID NO: 676 - DNA, 21 bp, Artificial Sequence
  Description of Artificial Sequence: Synthetic oligonucleotide
  modified_base (18)..(18): 2'-O-methylcytidine-5'-phosphate
  modified_base (21)..(21): 2'-deoxy-thymidine-5'-phosphate-phosphorothioate
agggaugauugguugucnatt

SEQ ID NO: 677 - DNA, 21 bp, Artificial Sequence
  Description of Artificial Sequence: Synthetic oligonucleotide
  modified_base (1)..(2): 2'-O-methyluridine-5'-phosphate
  modified_base (4)..(4): 2'-O-methyluridine-5'-phosphate
  modified_base (7)..(7): 2'-O-methylcytidine-5'-phosphate
  modified_base (9)..(9): 2'-O-methylcytidine-5'-phosphate
  modified_base (11)..(11): 2'-O-methyluridine-5'-phosphate
  modified_base (13)..(13): 2'-O-methyluridine-5'-phosphate
  modified_base (14)..(14): 2'-O-methylcytidine-5'-phosphate
  modified_base (16)..(17): 2'-O-methyluridine-5'-phosphate
  modified_base (18)..(18): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
nngnganangngnnannnntt

SEQ ID NO: 678 - DNA, 21 bp, Artificial Sequence
  Description of Artificial Sequence: Synthetic oligonucleotide
  modified_base (8)..(8): 2'-O-methylcytidine-5'-phosphate
  modified_base (15)..(15): 2'-O-methylcytidine-5'-phosphate
  modified_base (17)..(17): 2'-O-methylcytidine-5'-phosphate
  modified_base (21)..(21): 2'-deoxy-thymidine-5'-phosphate-phosphorothioate
agaauganacgugunanaatt

SEQ ID NO: 679 - DNA, 21 bp, Artificial Sequence
  Description of Artificial Sequence: Synthetic oligonucleotide
  modified_base (4)..(5): 2'-O-methylcytidine-5'-phosphate
  modified_base (8)..(9): 2'-O-methyluridine-5'-phosphate
  modified_base (11)..(12): 2'-O-methylcytidine-5'-phosphate
  modified_base (15)..(15): 2'-O-methyluridine-5'-phosphate
  modified_base (18)..(18): 2'-O-methylcytidine-5'-phosphate
  modified_base (21)..(21): 2'-deoxy-thymidine-5'-phosphate-phosphorothioate
aggnnaanngnnganganatt

SEQ ID NO: 680 - DNA, 21 bp, Artificial Sequence
  Description of Artificial Sequence: Synthetic oligonucleotide
  modified_base (4)..(4): 2'-O-methylcytidine-5'-phosphate
  modified_base (10)..(10): 2'-O-methylcytidine-5'-phosphate
  modified_base (21)..(21): 2'-deoxy-thymidine-5'-phosphate-phosphorothioate
ugunaucggnaauuggccutt

SEQ ID NO: 681 - DNA, 21 bp, Artificial Sequence
  Description of Artificial Sequence: Synthetic oligonucleotide
  modified_base (2)..(2): 2'-O-methyluridine-5'-phosphate
  modified_base (4)..(6): 2'-O-methylcytidine-5'-phosphate
  modified_base (7)..(7): 2'-O-methyluridine-5'-phosphate
  modified_base (9)..(9): 2'-O-methyluridine-5'-phosphate
  modified_base (10)..(10): 2'-O-methylcytidine-5'-phosphate
  modified_base (14)..(14): 2'-O-methyluridine-5'-phosphate
  modified_base (15)..(15): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
anannnngnnaggnnaaantt

SEQ ID NO: 682 - DNA, 21 bp, Artificial Sequence
  Description of Artificial Sequence: Synthetic oligonucleotide
  modified_base (12)..(12): 2'-O-methylcytidine-5'-phosphate
  modified_base (17)..(17): 2'-O-methyluridine-5'-phosphate
  modified_base (21)..(21): 2'-deoxy-thymidine-5'-phosphate-phosphorothioate
auuugaccuganagggnautt

SEQ ID NO: 683 - DNA, 21 bp, Artificial Sequence
  Description of Artificial Sequence: Synthetic oligonucleotide
  modified_base (1)..(1): 2'-O-methyluridine-5'-phosphate
  modified_base (3)..(5): 2'-O-methylcytidine-5'-phosphate
  modified_base (6)..(6): 2'-O-methyluridine-5'-phosphate
  modified_base (8)..(8): 2'-O-methyluridine-5'-phosphate
  modified_base (9)..(9): 2'-O-methylcytidine-5'-phosphate
  modified_base (13)..(13): 2'-O-methyluridine-5'-phosphate
  modified_base (14)..(14): 2'-O-methylcytidine-5'-phosphate
  modified_base (18)..(19): 2'-O-methyluridine-5'-phosphate
  modified_base (21)..(21): 2'-deoxy-thymidine-5'-phosphate-phosphorothioate
nannnngnnaggnnaaanntt

SEQ ID NO: 684 - DNA, 21 bp, Artificial Sequence
  Description of Artificial Sequence: Synthetic oligonucleotide
  modified_base (13)..(13): 2'-O-methylcytidine-5'-phosphate
  modified_base (18)..(18): 2'-O-methyluridine-5'-phosphate
  modified_base (21)..(21): 2'-deoxy-thymidine-5'-phosphate-phosphorothioate
aauuugaccuganagggnatt

SEQ ID NO: 685 - DNA, 21 bp, Artificial Sequence
  Description of Artificial Sequence: Synthetic oligonucleotide
  modified_base (1)..(2): 2'-O-methylcytidine-5'-phosphate
  modified_base (3)..(3): 2'-O-methyluridine-5'-phosphate
  modified_base (4)..(4): 2'-O-methylcytidine-5'-phosphate
  modified_base (5)..(5): 2'-O-methyluridine-5'-phosphate
  modified_base (9)..(9): 2'-O-methyluridine-5'-phosphate
  modified_base (11)..(11): 2'-O-methyluridine-5'-phosphate
  modified_base (12)..(12): 2'-O-methylcytidine-5'-phosphate
  modified_base (14)..(14): 2'-O-methylcytidine-5'-phosphate
  modified_base (15)..(15): 2'-O-methyluridine-5'-phosphate
  modified_base (18)..(18): 2'-O-methyluridine-5'-phosphate
  modified_base (19)..(19): 2'-O-methylcytidine-5'-phosphate
  modified_base (21)..(21): 2'-deoxy-thymidine-5'-phosphate-phosphorothioate
nnnnnaggngnngnnganntt

SEQ ID NO: 686 - DNA, 21 bp, Artificial Sequence
  Description of Artificial Sequence: Synthetic oligonucleotide
  modified_base (4)..(4): 2'-O-methylcytidine-5'-phosphate
  modified_base (10)..(10): 2'-O-methylcytidine-5'-phosphate
  modified_base (14)..(14): 2'-O-methyluridine-5'-phosphate
  modified_base (21)..(21): 2'-deoxy-thymidine-5'-phosphate-phosphorothioate
gaunagcganaccnagaggtt

SEQ ID NO: 687 - DNA, 21 bp, Artificial Sequence
  Description of Artificial Sequence: Synthetic oligonucleotide
  modified_base (1)..(2): 2'-O-methylcytidine-5'-phosphate
  modified_base (4)..(5): 2'-O-methylcytidine-5'-phosphate
  modified_base (7)..(7): 2'-O-methyluridine-5'-phosphate
  modified_base (8)..(8): 2'-O-methylcytidine-5'-phosphate
  modified_base (10)..(10): 2'-O-methyluridine-5'-phosphate
  modified_base (12)..(12): 2'-O-methylcytidine-5'-phosphate
  modified_base (13)..(14): 2'-O-methyluridine-5'-phosphate
  modified_base (16)..(16): 2'-O-methylcytidine-5'-phosphate
  modified_base (17)..(18): 2'-O-methyluridine-5'-phosphate
  modified_base (19)..(19): 2'-O-methylcytidine-5'-phosphate
  modified_base (21)..(21): 2'-deoxy-thymidine-5'-phosphate-phosphorothioate
nngnnannangnnngnnnntt

SEQ ID NO: 688 - DNA, 21 bp, Artificial Sequence
  Description of Artificial Sequence: Synthetic oligonucleotide
  modified_base (5)..(5): 2'-O-methylcytidine-5'-phosphate
  modified_base (9)..(9): 2'-O-methylcytidine-5'-phosphate
  modified_base (21)..(21): 2'-deoxy-thymidine-5'-phosphate-phosphorothioate
gaagnaagnaugauggcggtt

SEQ ID NO: 689 - DNA, 21 bp, Artificial Sequence
  Description of Artificial Sequence: Synthetic oligonucleotide
  modified_base (3)..(3): 2'-O-methylcytidine-5'-phosphate
  modified_base (4)..(4): 2'-O-methyluridine-5'-phosphate
  modified_base (7)..(8): 2'-O-methylcytidine-5'-phosphate
  modified_base (11)..(11): 2'-O-methyluridine-5'-phosphate
  modified_base (19)..(19): 2'-O-methyluridine-5'-phosphate
  modified_base (21)..(21): 2'-deoxy-thymidine-5'-phosphate-phosphorothioate
agnngannggnaagaaggntt

SEQ ID NO: 690 - DNA, 21 bp, Artificial Sequence
  Description of Artificial Sequence: Synthetic oligonucleotide
  modified_base (8)..(8): 2'-O-methyluridine-5'-phosphate
  modified_base (15)..(15): 2'-O-methylcytidine-5'-phosphate
  modified_base (21)..(21): 2'-deoxy-thymidine-5'-phosphate-phosphorothioate
accuucunaccggunagcutt

SEQ ID NO: 691 - DNA, 21 bp, Artificial Sequence
  Description of Artificial Sequence: Synthetic oligonucleotide
  modified_base (1)..(1): 2'-O-methyluridine-5'-phosphate
  modified_base (4)..(4): 2'-O-methylcytidine-5'-phosphate
  modified_base (6)..(7): 2'-O-methylcytidine-5'-phosphate
  modified_base (12)..(12): 2'-O-methyluridine-5'-phosphate
  modified_base (13)..(13): 2'-O-methylcytidine-5'-phosphate
  modified_base (16)..(16): 2'-O-methyluridine-5'-phosphate
  modified_base (17)..(17): 2'-O-methylcytidine-5'-phosphate
  modified_base (21)..(21): 2'-deoxy-thymidine-5'-phosphate-phosphorothioate
nganannggagnnagnnaatt

SEQ ID NO: 692 - DNA, 21 bp, Artificial Sequence
  Description of Artificial Sequence: Synthetic oligonucleotide
  modified_base (18)..(18): 2'-O-methylcytidine-5'-phosphate
  modified_base (21)..(21): 2'-deoxy-thymidine-5'-phosphate-phosphorothioate
uugacugacuccggugunatt

SEQ ID NO: 693 - DNA, 21 bp, Artificial Sequence
  Description of Artificial Sequence: Synthetic oligonucleotide
  modified_base (3)..(4): 2'-O-methyluridine-5'-phosphate
  modified_base (5)..(5): 2'-O-methylcytidine-5'-phosphate
  modified_base (7)..(8): 2'-O-methyluridine-5'-phosphate
  modified_base (9)..(9): 2'-O-methylcytidine-5'-phosphate
  modified_base (10)..(11): 2'-O-methyluridine-5'-phosphate
  modified_base (12)..(13): 2'-O-methylcytidine-5'-phosphate
  modified_base (15)..(16): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
agnnngnnnnnnngnnagntt

SEQ ID NO: 694 - DNA, 21 bp, Artificial Sequence
  Description of Artificial Sequence: Synthetic oligonucleotide
  modified_base (21)..(21): 2'-deoxy-thymidine-5'-phosphate-phosphorothioate
acuggcggaagaacgaacutt

SEQ ID NO: 695 - DNA, 21 bp, Artificial Sequence
  Description of Artificial Sequence: Synthetic oligonucleotide
  modified_base (2)..(3): 2'-O-methyluridine-5'-phosphate
  modified_base (4)..(4): 2'-O-methylcytidine-5'-phosphate
  modified_base (6)..(7): 2'-O-methyluridine-5'-phosphate
  modified_base (8)..(8): 2'-O-methylcytidine-5'-phosphate
  modified_base (9)..(10): 2'-O-methyluridine-5'-phosphate
  modified_base (11)..(12): 2'-O-methylcytidine-5'-phosphate
  modified_base (14)..(15): 2'-O-methylcytidine-5'-phosphate
  modified_base (18)..(18): 2'-O-methyluridine-5'-phosphate
  modified_base (19)..(19): 2'-O-methylcytidine-5'-phosphate
  modified_base (21)..(21): 2'-deoxy-thymidine-5'-phosphate-phosphorothioate
gnnngnnnnnnngnnagnntt

SEQ ID NO: 696 - DNA, 21 bp, Artificial Sequence
  Description of Artificial Sequence: Synthetic oligonucleotide
  modified_base (21)..(21): 2'-deoxy-thymidine-5'-phosphate-phosphorothioate
gacuggcggaagaacgaactt

SEQ ID NO: 697 - DNA, 21 bp, Artificial Sequence
  Description of Artificial Sequence: Synthetic oligonucleotide
  modified_base (1)..(2): 2'-O-methylcytidine-5'-phosphate
  modified_base (3)..(3): 2'-O-methyluridine-5'-phosphate
  modified_base (7)..(7): 2'-O-methyluridine-5'-phosphate
  modified_base (9)..(10): 2'-O-methylcytidine-5'-phosphate
  modified_base (12)..(12): 2'-O-methyluridine-5'-phosphate
  modified_base (14)..(16): 2'-O-methyluridine-5'-phosphate
  modified_base (17)..(17): 2'-O-methylcytidine-5'-phosphate
  modified_base (21)..(21): 2'-deoxy-thymidine-5'-phosphate-phosphorothioate
nnngganannanannnnggtt

SEQ ID NO: 698 - DNA, 21 bp, Artificial Sequence
  Description of Artificial Sequence: Synthetic oligonucleotide
  modified_base (7)..(7): 2'-O-methyluridine-5'-phosphate
  modified_base (12)..(12): 2'-O-methyluridine-5'-phosphate
  modified_base (16)..(16): 2'-O-methylcytidine-5'-phosphate
  modified_base (21)..(21): 2'-deoxy-thymidine-5'-phosphate-phosphorothioate
ccgaaanauggnaucnaggtt

SEQ ID NO: 699 - DNA, 21 bp, Artificial Sequence
  Description of Artificial Sequence: Synthetic oligonucleotide
  modified_base (1)..(1): 2'-O-methylcytidine-5'-phosphate
  modified_base (2)..(2): 2'-O-methyluridine-5'-phosphate
  modified_base (6)..(6): 2'-O-methyluridine-5'-phosphate
  modified_base (8)..(9): 2'-O-methylcytidine-5'-phosphate
  modified_base (11)..(11): 2'-O-methyluridine-5'-phosphate
  modified_base (13)..(15): 2'-O-methyluridine-5'-phosphate
  modified_base (16)..(16): 2'-O-methylcytidine-5'-phosphate
  modified_base (21)..(21): 2'-deoxy-thymidine-5'-phosphate-phosphorothioate
nngganannanannnngggtt

SEQ ID NO: 700 - DNA, 21 bp, Artificial Sequence
  Description of Artificial Sequence: Synthetic oligonucleotide
  modified_base (8)..(8): 2'-O-methyluridine-5'-phosphate
  modified_base (13)..(13): 2'-O-methyluridine-5'-phosphate
  modified_base (17)..(17): 2'-O-methylcytidine-5'-phosphate
  modified_base (21)..(21): 2'-deoxy-thymidine-5'-phosphate-phosphorothioate
cccgaaanauggnaucnagtt

SEQ ID NO: 701 - DNA, 21 bp, Artificial Sequence
  Description of Artificial Sequence: Synthetic oligonucleotide
  modified_base (3)..(3): 2'-O-methylcytidine-5'-phosphate
  modified_base (4)..(4): 2'-O-methyluridine-5'-phosphate
  modified_base (7)..(8): 2'-O-methylcytidine-5'-phosphate
  modified_base (11)..(11): 2'-O-methylcytidine-5'-phosphate
  modified_base (16)..(16): 2'-O-methylcytidine-5'-phosphate
  modified_base (19)..(19): 2'-O-methylcytidine-5'-phosphate
  modified_base (21)..(21): 2'-deoxy-thymidine-5'-phosphate-phosphorothioate
agnnggnnaangagangantt

SEQ ID NO: 702 - DNA, 21 bp, Artificial Sequence
  Description of Artificial Sequence: Synthetic oligonucleotide
  modified_base (15)..(15): 2'-O-methylcytidine-5'-phosphate
  modified_base (21)..(21): 2'-deoxy-thymidine-5'-phosphate-phosphorothioate
gucgucucguuggcnagcutt

SEQ ID NO: 703 - DNA, 21 bp, Artificial Sequence
  Description of Artificial Sequence: Synthetic oligonucleotide
  modified_base (1)..(1): 2'-O-methyluridine-5'-phosphate
  modified_base (4)..(5): 2'-O-methylcytidine-5'-phosphate
  modified_base (8)..(8): 2'-O-methylcytidine-5'-phosphate
  modified_base (13)..(13): 2'-O-methylcytidine-5'-phosphate
  modified_base (16)..(16): 2'-O-methylcytidine-5'-phosphate
  modified_base (17)..(17): 2'-O-methyluridine-5'-phosphate
  modified_base (18)..(18): 2'-O-methylcytidine-5'-phosphate
  modified_base (21)..(21): 2'-deoxy-thymidine-5'-phosphate-phosphorothioate
nggnnaangagangannnatt

SEQ ID NO: 704 - DNA, 21 bp, Artificial Sequence
  Description of Artificial Sequence: Synthetic oligonucleotide
  modified_base (18)..(18): 2'-O-methylcytidine-5'-phosphate
  modified_base (21)..(21): 2'-deoxy-thymidine-5'-phosphate-phosphorothioate
ugagucgucucguuggcnatt

SEQ ID NO: 705 - DNA, 21 bp, Artificial Sequence
  Description of Artificial Sequence: Synthetic oligonucleotide
  modified_base (3)..(3): 2'-O-methyluridine-5'-phosphate
  modified_base (5)..(6): 2'-O-methylcytidine-5'-phosphate
  modified_base (8)..(8): 2'-O-methyluridine-5'-phosphate
  modified_base (10)..(12): 2'-O-methyluridine-5'-phosphate
  modified_base (13)..(13): 2'-O-methylcytidine-5'-phosphate
  modified_base (17)..(18): 2'-O-methylcytidine-5'-phosphate
  modified_base (21)..(21): 2'-deoxy-thymidine-5'-phosphate-phosphorothioate
ganannanannnngggnnatt

SEQ ID NO: 706 - DNA, 21 bp, Artificial Sequence
  Description of Artificial Sequence: Synthetic oligonucleotide
  modified_base (11)..(11): 2'-O-methyluridine-5'-phosphate
  modified_base (16)..(16): 2'-O-methyluridine-5'-phosphate
  modified_base (21)..(21): 2'-deoxy-thymidine-5'-phosphate-phosphorothioate
uggcccgaaanauggnauctt

SEQ ID NO: 707 - DNA, 21 bp, Artificial Sequence
  Description of Artificial Sequence: Synthetic oligonucleotide
  modified_base (1)..(1): 2'-O-methylcytidine-5'-phosphate
  modified_base (5)..(5): 2'-O-methylcytidine-5'-phosphate
  modified_base (6)..(6): 2'-O-methyluridine-5'-phosphate
  modified_base (8)..(8): 2'-O-methylcytidine-5'-phosphate
  modified_base (9)..(9): 2'-O-methyluridine-5'-phosphate
  modified_base (11)..(11): 2'-O-methyluridine-5'-phosphate
  modified_base (13)..(13): 2'-O-methyluridine-5'-phosphate
  modified_base (14)..(14): 2'-O-methylcytidine-5'-phosphate
  modified_base (18)..(19): 2'-O-methylcytidine-5'-phosphate
  modified_base (21)..(21): 2'-deoxy-thymidine-5'-phosphate-phosphorothioate
ngganngnngnanngaanntt

SEQ ID NO: 708 - DNA, 21 bp, Artificial Sequence
  Description of Artificial Sequence: Synthetic oligonucleotide
  modified_base (8)..(8): 2'-O-methyluridine-5'-phosphate
  modified_base (10)..(10): 2'-O-methylcytidine-5'-phosphate
  modified_base (13)..(13): 2'-O-methylcytidine-5'-phosphate
  modified_base (21)..(21): 2'-deoxy-thymidine-5'-phosphate-phosphorothioate
gguucgananagnaguccgtt

SEQ ID NO: 709 - DNA, 21 bp, Artificial Sequence
  Description of Artificial Sequence: Synthetic oligonucleotide
  modified_base (1)..(1): 2'-O-methyluridine-5'-phosphate
  modified_base (6)..(7): 2'-O-methyluridine-5'-phosphate
  modified_base (9)..(9): 2'-O-methylcytidine-5'-phosphate
  modified_base (13)..(13): 2'-O-methylcytidine-5'-phosphate
  modified_base (15)..(16): 2'-O-methyluridine-5'-phosphate
  modified_base (18)..(18): 2'-O-methyluridine-5'-phosphate
  modified_base (21)..(21): 2'-deoxy-thymidine-5'-phosphate-phosphorothioate
nggagnnanaggngnnanatt

SEQ ID NO: 710 - DNA, 21 bp, Artificial Sequence
  Description of Artificial Sequence: Synthetic oligonucleotide
  modified_base (1)..(1): 2'-O-methyluridine-5'-phosphate
  modified_base (3)..(3): 2'-O-methyluridine-5'-phosphate
  modified_base (12)..(12): 2'-O-methyluridine-5'-phosphate
  modified_base (18)..(18): 2'-O-methylcytidine-5'-phosphate
  modified_base (21)..(21): 2'-deoxy-thymidine-5'-phosphate-phosphorothioate
nanaacgccugnaacucnatt

SEQ ID NO: 711 - DNA, 21 bp, Artificial Sequence
  Description of Artificial Sequence: Synthetic oligonucleotide
  modified_base (1)..(1): 2'-O-methyluridine-5'-phosphate
  modified_base (4)..(5): 2'-O-methyluridine-5'-phosphate
  modified_base (7)..(7): 2'-O-methylcytidine-5'-phosphate
  modified_base (10)..(11): 2'-O-methyluridine-5'-phosphate
  modified_base (13)..(13): 2'-O-methyluridine-5'-phosphate
  modified_base (14)..(14): 2'-O-methylcytidine-5'-phosphate
  modified_base (16)..(16): 2'-O-methylcytidine-5'-phosphate
  modified_base (17)..(19): 2'-O-methyluridine-5'-phosphate
  modified_base (21)..(21): 2'-deoxy-thymidine-5'-phosphate-phosphorothioate
naanngnagnnanngnnnntt

SEQ ID NO: 712 - DNA, 21 bp, Artificial Sequence
  Description of Artificial Sequence: Synthetic oligonucleotide
  modified_base (8)..(8): 2'-O-methyluridine-5'-phosphate
  modified_base (14)..(14): 2'-O-methylcytidine-5'-phosphate
  modified_base (18)..(18): 2'-O-methyluridine-5'-phosphate
  modified_base (21)..(21): 2'-deoxy-thymidine-5'-phosphate-phosphorothioate
aaagcganaacugnaaunatt

SEQ ID NO: 713 - DNA, 21 bp, Artificial Sequence
  Description of Artificial Sequence: Synthetic oligonucleotide
  modified_base (4)..(5): 2'-O-methyluridine-5'-phosphate
  modified_base (7)..(7): 2'-O-methylcytidine-5'-phosphate
  modified_base (11)..(11): 2'-O-methylcytidine-5'-phosphate
  modified_base (13)..(14): 2'-O-methyluridine-5'-phosphate
  modified_base (16)..(16): 2'-O-methyluridine-5'-phosphate
  modified_base (19)..(19): 2'-O-methyluridine-5'-phosphate
  modified_base (21)..(21): 2'-deoxy-thymidine-5'-phosphate-phosphorothioate
gagnnanaggngnnanaantt

SEQ ID NO: 714 - DNA, 21 bp, Artificial Sequence
  Description of Artificial Sequence: Synthetic oligonucleotide
  modified_base (3)..(3): 2'-O-methyluridine-5'-phosphate
  modified_base (5)..(5): 2'-O-methyluridine-5'-phosphate
  modified_base (14)..(14): 2'-O-methyluridine-5'-phosphate
  modified_base (21)..(21): 2'-deoxy-thymidine-5'-phosphate-phosphorothioate
aunanaacgccugnaacuctt

SEQ ID NO: 715 - DNA, 21 bp, Artificial Sequence
  Description of Artificial Sequence: Synthetic oligonucleotide
  modified_base (3)..(3): 2'-O-methylcytidine-5'-phosphate
  modified_base (4)..(4): 2'-O-methyluridine-5'-phosphate
  modified_base (6)..(6): 2'-O-methylcytidine-5'-phosphate
  modified_base (7)..(7): 2'-O-methyluridine-5'-phosphate
  modified_base (9)..(9): 2'-O-methyluridine-5'-phosphate
  modified_base (11)..(11): 2'-O-methyluridine-5'-phosphate
  modified_base (12)..(12): 2'-O-methylcytidine-5'-phosphate
  modified_base (16)..(17): 2'-O-methylcytidine-5'-phosphate
  modified_base (19)..(19): 2'-O-methylcytidine-5'-phosphate
  modified_base (21)..(21): 2'-deoxy-thymidine-5'-phosphate-phosphorothioate
ganngnngnanngaannantt

SEQ ID NO: 716 - DNA, 21 bp, Artificial Sequence
  Description of Artificial Sequence: Synthetic oligonucleotide
  modified_base (10)..(10): 2'-O-methyluridine-5'-phosphate
  modified_base (12)..(12): 2'-O-methylcytidine-5'-phosphate
  modified_base (15)..(15): 2'-O-methylcytidine-5'-phosphate
  modified_base (21)..(21): 2'-deoxy-thymidine-5'-phosphate-phosphorothioate
gugguucgananagnaguctt

SEQ ID NO: 717 - DNA, 21 bp, Artificial Sequence
  Description of Artificial Sequence: Synthetic oligonucleotide
  modified_base (1)..(1): 2'-O-methyluridine-5'-phosphate
  modified_base (2)..(3): 2'-O-methylcytidine-5'-phosphate
  modified_base (4)..(4): 2'-O-methyluridine-5'-phosphate
  modified_base (5)..(5): 2'-O-methylcytidine-5'-phosphate
  modified_base (8)..(9): 2'-O-methylcytidine-5'-phosphate
  modified_base (11)..(11): 2'-O-methyluridine-5'-phosphate
  modified_base (16)..(16): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
nnnnnaanngnaaggnaantt

SEQ ID NO: 718 - DNA, 21 bp, Artificial Sequence
  Description of Artificial Sequence: Synthetic oligonucleotide
  modified_base (8)..(8): 2'-O-methyluridine-5'-phosphate
  modified_base (21)..(21): 2'-deoxy-thymidine-5'-phosphate-phosphorothioate
auugccunacgguugaggatt

SEQ ID NO: 719 - DNA, 21 bp, Artificial Sequence
  Description of Artificial Sequence: Synthetic oligonucleotide
  modified_base (1)..(2): 2'-O-methylcytidine-5'-phosphate
  modified_base (3)..(3): 2'-O-methyluridine-5'-phosphate
  modified_base (4)..(4): 2'-O-methylcytidine-5'-phosphate
  modified_base (7)..(8): 2'-O-methylcytidine-5'-phosphate
  modified_base (10)..(10): 2'-O-methyluridine-5'-phosphate
  modified_base (15)..(15): 2'-O-methylcytidine-5'-phosphate
  modified_base (18)..(19): 2'-O-methyluridine-5'-phosphate
  modified_base (21)..(21): 2'-deoxy-thymidine-5'-phosphate-phosphorothioate
nnnnaanngnaaggnaanntt

SEQ ID NO: 720 - DNA, 21 bp, Artificial Sequence
  Description of Artificial Sequence: Synthetic oligonucleotide
  modified_base (9)..(9): 2'-O-methyluridine-5'-phosphate
  modified_base (21)..(21): 2'-deoxy-thymidine-5'-phosphate-phosphorothioate
aauugccunacgguugaggtt

SEQ ID NO: 721 - DNA, 21 bp, Artificial Sequence
  Description of Artificial Sequence: Synthetic oligonucleotide
  modified_base (3)..(3): 2'-O-methyluridine-5'-phosphate
  modified_base (5)..(5): 2'-O-methylcytidine-5'-phosphate
  modified_base (7)..(9): 2'-O-methylcytidine-5'-phosphate
  modified_base (11)..(11): 2'-O-methyluridine-5'-phosphate
  modified_base (13)..(13): 2'-O-methyluridine-5'-phosphate
  modified_base (15)..(15): 2'-O-methyluridine-5'-phosphate
  modified_base (19)..(19): 2'-O-methylcytidine-5'-phosphate
  modified_base (21)..(21): 2'-deoxy-thymidine-5'-phosphate-phosphorothioate
aananannngngnanaaantt

SEQ ID NO: 722 - DNA, 21 bp, Artificial Sequence
  Description of Artificial Sequence: Synthetic oligonucleotide
  modified_base (4)..(4): 2'-O-methyluridine-5'-phosphate
  modified_base (6)..(6): 2'-O-methyluridine-5'-phosphate
  modified_base (8)..(8): 2'-O-methylcytidine-5'-phosphate
  modified_base (16)..(16): 2'-O-methyluridine-5'-phosphate
  modified_base (21)..(21): 2'-deoxy-thymidine-5'-phosphate-phosphorothioate
guunananacgggugnauutt

SEQ ID NO: 723 - DNA, 21 bp, Artificial Sequence
  Description of Artificial Sequence: Synthetic oligonucleotide
  modified_base (2)..(3): 2'-O-methylcytidine-5'-phosphate
  modified_base (6)..(6): 2'-O-methylcytidine-5'-phosphate
  modified_base (11)..(11): 2'-O-methylcytidine-5'-phosphate
  modified_base (14)..(14): 2'-O-methylcytidine-5'-phosphate
  modified_base (15)..(15): 2'-O-methyluridine-5'-phosphate
  modified_base (16)..(16): 2'-O-methylcytidine-5'-phosphate
  modified_base (21)..(21): 2'-deoxy-thymidine-5'-phosphate-phosphorothioate
gnnaangagangannnaagtt

SEQ ID NO: 724 - DNA, 21 bp, Artificial Sequence
  Description of Artificial Sequence: Synthetic oligonucleotide
  modified_base (21)..(21): 2'-deoxy-thymidine-5'-phosphate-phosphorothioate
cuugagucgucucguuggctt

SEQ ID NO: 725 - DNA, 21 bp, Artificial Sequence
  Description of Artificial Sequence: Synthetic oligonucleotide
  modified_base (3)..(4): 2'-O-methyluridine-5'-phosphate
  modified_base (6)..(6): 2'-O-methylcytidine-5'-phosphate
  modified_base (10)..(10): 2'-O-methylcytidine-5'-phosphate
  modified_base (12)..(13): 2'-O-methyluridine-5'-phosphate
  modified_base (15)..(15): 2'-O-methyluridine-5'-phosphate
  modified_base (18)..(19): 2'-O-methyluridine-5'-phosphate
  modified_base (21)..(21): 2'-deoxy-thymidine-5'-phosphate-phosphorothioate
agnnanaggngnnanaanntt

SEQ ID NO: 726 - DNA, 21 bp, Artificial Sequence
  Description of Artificial Sequence: Synthetic oligonucleotide
  modified_base (4)..(4): 2'-O-methyluridine-5'-phosphate
  modified_base (6)..(6): 2'-O-methyluridine-5'-phosphate
  modified_base (15)..(15): 2'-O-methyluridine-5'-phosphate
  modified_base (21)..(21): 2'-deoxy-thymidine-5'-phosphate-phosphorothioate
aaunanaacgccugnaacutt

SEQ ID NO: 727 - DNA, 21 bp, Artificial Sequence
  Description of Artificial Sequence: Synthetic oligonucleotide
  modified_base (2)..(2): 2'-O-methyluridine-5'-phosphate
  modified_base (4)..(4): 2'-O-methylcytidine-5'-phosphate
  modified_base (6)..(8): 2'-O-methylcytidine-5'-phosphate
  modified_base (10)..(10): 2'-O-methyluridine-5'-phosphate
  modified_base (12)..(12): 2'-O-methyluridine-5'-phosphate
  modified_base (14)..(14): 2'-O-methyluridine-5'-phosphate
  modified_base (18)..(18): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
ananannngngnanaaanntt

SEQ ID NO: 728 - DNA, 21 bp, Artificial Sequence
  Description of Artificial Sequence: Synthetic oligonucleotide
  modified_base (5)..(5): 2'-O-methyluridine-5'-phosphate
  modified_base (7)..(7): 2'-O-methyluridine-5'-phosphate
  modified_base (9)..(9): 2'-O-methylcytidine-5'-phosphate
  modified_base (17)..(17): 2'-O-methyluridine-5'-phosphate
  modified_base (21)..(21): 2'-deoxy-thymidine-5'-phosphate-phosphorothioate
aguunananacgggugnautt

SEQ ID NO: 729 - DNA, 21 bp, Artificial Sequence
  Description of Artificial Sequence: Synthetic oligonucleotide
  modified_base (1)..(1): 2'-O-methyluridine-5'-phosphate
  modified_base (3)..(3): 2'-O-methylcytidine-5'-phosphate
  modified_base (7)..(7): 2'-O-methylcytidine-5'-phosphate
  modified_base (9)..(10): 2'-O-methyluridine-5'-phosphate
  modified_base (12)..(12): 2'-O-methyluridine-5'-phosphate
  modified_base (15)..(16): 2'-O-methyluridine-5'-phosphate
  modified_base (18)..(18): 2'-O-methylcytidine-5'-phosphate
  modified_base (21)..(21): 2'-deoxy-thymidine-5'-phosphate-phosphorothioate
nanaggngnnanaanngnatt

SEQ ID NO: 730 - DNA, 21 bp, Artificial Sequence
  Description of Artificial Sequence: Synthetic oligonucleotide
  modified_base (3)..(3): 2'-O-methylcytidine-5'-phosphate
  modified_base (7)..(7): 2'-O-methyluridine-5'-phosphate
  modified_base (9)..(9): 2'-O-methyluridine-5'-phosphate
  modified_base (18)..(18): 2'-O-methyluridine-5'-phosphate
  modified_base (21)..(21): 2'-deoxy-thymidine-5'-phosphate-phosphorothioate
ugnaaunanaacgccugnatt

SEQ ID NO: 731 - DNA, 21 bp, Artificial Sequence
  Description of Artificial Sequence: Synthetic oligonucleotide
  modified_base (1)..(1): 2'-O-methylcytidine-5'-phosphate
  modified_base (4)..(4): 2'-O-methyluridine-5'-phosphate
  modified_base (6)..(6): 2'-O-methylcytidine-5'-phosphate
  modified_base (7)..(7): 2'-O-methyluridine-5'-phosphate
  modified_base (8)..(8): 2'-O-methylcytidine-5'-phosphate
  modified_base (11)..(13): 2'-O-methylcytidine-5'-phosphate
  modified_base (17)..(17): 2'-O-methyluridine-5'-phosphate
  modified_base (19)..(19): 2'-O-methylcytidine-5'-phosphate
  modified_base (21)..(21): 2'-deoxy-thymidine-5'-phosphate-phosphorothioate
naangnnnaannnaaangntt

SEQ ID NO: 732 - DNA, 21 bp, Artificial Sequence
  Description of Artificial Sequence: Synthetic oligonucleotide
  modified_base (2)..(2): 2'-O-methylcytidine-5'-phosphate
  modified_base (15)..(15): 2'-O-methylcytidine-5'-phosphate
  modified_base (21)..(21): 2'-deoxy-thymidine-5'-phosphate-phosphorothioate
gnauuuggguugagnauugtt

SEQ ID NO: 733 - DNA, 21 bp, Artificial Sequence
  Description of Artificial Sequence: Synthetic oligonucleotide
  modified_base (1)..(2): 2'-O-methylcytidine-5'-phosphate
  modified_base (5)..(5): 2'-O-methylcytidine-5'-phosphate
  modified_base (10)..(10): 2'-O-methylcytidine-5'-phosphate
  modified_base (13)..(13): 2'-O-methylcytidine-5'-phosphate
  modified_base (14)..(14): 2'-O-methyluridine-5'-phosphate
  modified_base (15)..(15): 2'-O-methylcytidine-5'-phosphate
  modified_base (19)..(19): 2'-O-methylcytidine-5'-phosphate
  modified_base (21)..(21): 2'-deoxy-thymidine-5'-phosphate-phosphorothioate
nnaangagangannnaagntt

SEQ ID NO: 734 - DNA, 21 bp, Artificial Sequence
  Description of Artificial Sequence: Synthetic oligonucleotide
  modified_base (21)..(21): 2'-deoxy-thymidine-5'-phosphate-phosphorothioate
gcuugagucgucucguuggtt

SEQ ID NO: 735 - DNA, 21 bp, Artificial Sequence
  Description of Artificial Sequence: Synthetic oligonucleotide
  modified_base (1)..(3): 2'-O-methylcytidine-5'-phosphate
  modified_base (5)..(5): 2'-O-methyluridine-5'-phosphate
  modified_base (7)..(7): 2'-O-methyluridine-5'-phosphate
  modified_base (9)..(9): 2'-O-methyluridine-5'-phosphate
  modified_base (13)..(13): 2'-O-methylcytidine-5'-phosphate
  modified_base (14)..(15): 2'-O-methyluridine-5'-phosphate
  modified_base (18)..(18): 2'-O-methylcytidine-5'-phosphate
  modified_base (21)..(21): 2'-deoxy-thymidine-5'-phosphate-phosphorothioate
nnngngnanaaannnganatt

SEQ ID NO: 736 - DNA, 21 bp, Artificial Sequence
  Description of Artificial Sequence: Synthetic oligonucleotide
  modified_base (4)..(4): 2'-O-methylcytidine-5'-phosphate
  modified_base (10)..(10): 2'-O-methyluridine-5'-phosphate
  modified_base (12)..(12): 2'-O-methyluridine-5'-phosphate
  modified_base (14)..(14): 2'-O-methylcytidine-5'-phosphate
  modified_base (21)..(21): 2'-deoxy-thymidine-5'-phosphate-phosphorothioate
ugunaaguunananacgggtt

SEQ ID NO: 737 - DNA, 21 bp, Artificial Sequence
  Description of Artificial Sequence: Synthetic oligonucleotide
  modified_base (2)..(2): 2'-O-methylcytidine-5'-phosphate
  modified_base (3)..(3): 2'-O-methyluridine-5'-phosphate
  modified_base (5)..(5): 2'-O-methylcytidine-5'-phosphate
  modified_base (7)..(7): 2'-O-methylcytidine-5'-phosphate
  modified_base (9)..(10): 2'-O-methylcytidine-5'-phosphate
  modified_base (11)..(14): 2'-O-methyluridine-5'-phosphate
  modified_base (15)..(15): 2'-O-methylcytidine-5'-phosphate
  modified_base (18)..(18): 2'-O-methyluridine-5'-phosphate
  modified_base (19)..(19): 2'-O-methylcytidine-5'-phosphate
  modified_base (21)..(21): 2'-deoxy-thymidine-5'-phosphate-phosphorothioate
gnnangnannnnnnnaanntt

SEQ ID NO: 738 - DNA, 21 bp, Artificial Sequence
  Description of Artificial Sequence: Synthetic oligonucleotide
  modified_base (16)..(16): 2'-O-methyluridine-5'-phosphate
  modified_base (21)..(21): 2'-deoxy-thymidine-5'-phosphate-phosphorothioate
gauugaaaaggugcgnagctt

SEQ ID NO: 739 - DNA, 21 bp, Artificial Sequence
  Description of Artificial Sequence: Synthetic oligonucleotide
  modified_base (3)..(4): 2'-O-methylcytidine-5'-phosphate
  modified_base (8)..(8): 2'-O-methylcytidine-5'-phosphate
  modified_base (9)..(9): 2'-O-methyluridine-5'-phosphate
  modified_base (11)..(11): 2'-O-methylcytidine-5'-phosphate
  modified_base (12)..(12): 2'-O-methyluridine-5'-phosphate
  modified_base (14)..(14): 2'-O-methyluridine-5'-phosphate
  modified_base (16)..(16): 2'-O-methyluridine-5'-phosphate
  modified_base (17)..(17): 2'-O-methylcytidine-5'-phosphate
  modified_base (21)..(21): 2'-deoxy-thymidine-5'-phosphate-phosphorothioate
ganngganngnngnanngatt

SEQ ID NO: 740 - DNA, 21 bp, Artificial Sequence
  Description of Artificial Sequence: Synthetic oligonucleotide
  modified_base (5)..(5): 2'-O-methyluridine-5'-phosphate
  modified_base (7)..(7): 2'-O-methylcytidine-5'-phosphate
  modified_base (10)..(10): 2'-O-methylcytidine-5'-phosphate
  modified_base (21)..(21): 2'-deoxy-thymidine-5'-phosphate-phosphorothioate
ucgananagnaguccgguctt

SEQ ID NO: 741 - DNA, 21 bp, Artificial Sequence
  Description of Artificial Sequence: Synthetic oligonucleotide
  modified_base (1)..(1): 2'-O-methyluridine-5'-phosphate
  modified_base (3)..(3): 2'-O-methyluridine-5'-phosphate
  modified_base (5)..(5): 2'-O-methyluridine-5'-phosphate
  modified_base (6)..(6): 2'-O-methylcytidine-5'-phosphate
  modified_base (10)..(11): 2'-O-methylcytidine-5'-phosphate
  modified_base (13)..(13): 2'-O-methylcytidine-5'-phosphate
  modified_base (15)..(15): 2'-O-methyluridine-5'-phosphate
  modified_base (18)..(19): 2'-O-methyluridine-5'-phosphate
  modified_base (21)..(21): 2'-deoxy-thymidine-5'-phosphate-phosphorothioate
ngnanngaannananganntt

SEQ ID NO: 742 - DNA, 21 bp, Artificial Sequence
  Description of Artificial Sequence: Synthetic oligonucleotide
  modified_base (4)..(4): 2'-O-methylcytidine-5'-phosphate
  modified_base (16)..(16): 2'-O-methyluridine-5'-phosphate
  modified_base (18)..(18): 2'-O-methylcytidine-5'-phosphate
  modified_base (21)..(21): 2'-deoxy-thymidine-5'-phosphate-phosphorothioate
aaunaugugguucgananatt

SEQ ID NO: 743 - DNA, 21 bp, Artificial Sequence
  Description of Artificial Sequence: Synthetic oligonucleotide
  modified_base (4)..(4): 2'-O-methyluridine-5'-phosphate
  modified_base (8)..(8): 2'-O-methyluridine-5'-phosphate
  modified_base (10)..(11): 2'-O-methylcytidine-5'-phosphate
  modified_base (13)..(13): 2'-O-methyluridine-5'-phosphate
  modified_base (14)..(14): 2'-O-methylcytidine-5'-phosphate
  modified_base (17)..(17): 2'-O-methyluridine-5'-phosphate
  modified_base (18)..(18): 2'-O-methylcytidine-5'-phosphate
  modified_base (21)..(21): 2'-deoxy-thymidine-5'-phosphate-phosphorothioate
aggngagnanngnnaannatt

SEQ ID NO: 744 - DNA, 21 bp, Artificial Sequence
  Description of Artificial Sequence: Synthetic oligonucleotide
  modified_base (11)..(11): 2'-O-methyluridine-5'-phosphate
  modified_base (15)..(15): 2'-O-methylcytidine-5'-phosphate
  modified_base (21)..(21): 2'-deoxy-thymidine-5'-phosphate-phosphorothioate
ugauugacggnacunaccutt

SEQ ID NO: 745 - DNA, 21 bp, Artificial Sequence
  Description of Artificial Sequence: Synthetic oligonucleotide
  modified_base (6)..(6): 2'-O-methylcytidine-5'-phosphate
  modified_base (8)..(8): 2'-O-methyluridine-5'-phosphate
  modified_base (10)..(10): 2'-O-methyluridine-5'-phosphate
  modified_base (12)..(12): 2'-O-methyluridine-5'-phosphate
  modified_base (13)..(14): 2'-O-methylcytidine-5'-phosphate
  modified_base (17)..(18): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
aaagananangnnngannntt

SEQ ID NO: 746 - DNA, 21 bp, Artificial Sequence
  Description of Artificial Sequence: Synthetic oligonucleotide
  modified_base (9)..(9): 2'-O-methylcytidine-5'-phosphate
  modified_base (11)..(11): 2'-O-methyluridine-5'-phosphate
  modified_base (21)..(21): 2'-deoxy-thymidine-5'-phosphate-phosphorothioate
aggucggananaugucuuutt

SEQ ID NO: 747 - DNA, 21 bp, Artificial Sequence
  Description of Artificial Sequence: Synthetic oligonucleotide
  modified_base (1)..(1): 2'-O-methyluridine-5'-phosphate
  modified_base (2)..(2): 2'-O-methylcytidine-5'-phosphate
  modified_base (3)..(3): 2'-O-methyluridine-5'-phosphate
  modified_base (4)..(4): 2'-O-methylcytidine-5'-phosphate
  modified_base (9)..(9): 2'-O-methyluridine-5'-phosphate
  modified_base (11)..(11): 2'-O-methyluridine-5'-phosphate
  modified_base (13)..(13): 2'-O-methyluridine-5'-phosphate
  modified_base (14..(14): 2'-O-methylcytidine-5'-phosphate
  modified_base (17)..(17): 2'-O-methylcytidine-5'-phosphate
  modified_base (21)..(21): 2'-deoxy-thymidine-5'-phosphate-phosphorothioate
nnnngaagnanannaangatt

SEQ ID NO: 748 - DNA, 21 bp, Artificial Sequence
  Description of Artificial Sequence: Synthetic oligonucleotide
  modified_base (8)..(8): 2'-O-methyluridine-5'-phosphate
  modified_base (10)..(10): 2'-O-methyluridine-5'-phosphate
  modified_base (21)..(21): 2'-deoxy-thymidine-5'-phosphate-phosphorothioate
ucguugananacuucgagatt

SEQ ID NO: 749 - DNA, 21 bp, Artificial Sequence
  Description of Artificial Sequence: Synthetic oligonucleotide
  modified_base (1)..(1): 2'-O-methyluridine-5'-phosphate
  modified_base (6)..(7): 2'-O-methylcytidine-5'-phosphate
  modified_base (10)..(10): 2'-O-methylcytidine-5'-phosphate
  modified_base (13)..(13): 2'-O-methyluridine-5'-phosphate
  modified_base (14)..(16): 2'-O-methylcytidine-5'-phosphate
  modified_base (17)..(17): 2'-O-methyluridine-5'-phosphate
  modified_base (21)..(21): 2'-deoxy-thymidine-5'-phosphate-phosphorothioate
ngggannganaannnnnaatt

SEQ ID NO: 750 - DNA, 21 bp, Artificial Sequence
  Description of Artificial Sequence: Synthetic oligonucleotide
  modified_base (2)..(2): 2'-O-methyluridine-5'-phosphate
  modified_base (18)..(18): 2'-O-methylcytidine-5'-phosphate
  modified_base (21)..(21): 2'-deoxy-thymidine-5'-phosphate-phosphorothioate
unagggauugucgguccnatt

SEQ ID NO: 751 - DNA, 21 bp, Artificial Sequence
  Description of Artificial Sequence: Synthetic oligonucleotide
  modified_base (1)..(1): 2'-O-methyluridine-5'-phosphate
  modified_base (2)..(3): 2'-O-methylcytidine-5'-phosphate
  modified_base (4)..(4): 2'-O-methyluridine-5'-phosphate
  modified_base (6)..(6): 2'-O-methylcytidine-5'-phosphate
  modified_base (7)..(7): 2'-O-methyluridine-5'-phosphate
  modified_base (10)..(10): 2'-O-methyluridine-5'-phosphate
  modified_base (11)..(11): 2'-O-methylcytidine-5'-phosphate
  modified_base (13)..(15): 2'-O-methylcytidine-5'-phosphate
  modified_base (17)..(17): 2'-O-methyluridine-5'-phosphate
  modified_base (21)..(21): 2'-deoxy-thymidine-5'-phosphate-phosphorothioate
nnnnannaanngnnngnaatt

SEQ ID NO: 752 - DNA, 21 bp, Artificial Sequence
  Description of Artificial Sequence: Synthetic oligonucleotide
  modified_base (2)..(2): 2'-O-methyluridine-5'-phosphate
  modified_base (12)..(12): 2'-O-methyluridine-5'-phosphate
  modified_base (15)..(15): 2'-O-methyluridine-5'-phosphate
  modified_base (21)..(21): 2'-deoxy-thymidine-5'-phosphate-phosphorothioate
unacgggcgaunagnaggatt

SEQ ID NO: 753 - DNA, 21 bp, Artificial Sequence
  Description of Artificial Sequence: Synthetic oligonucleotide
  modified_base (3)..(3): 2'-O-methylcytidine-5'-phosphate
  modified_base (5)..(5): 2'-O-methyluridine-5'-phosphate
  modified_base (7)..(7): 2'-O-methyluridine-5'-phosphate
  modified_base (9)..(9): 2'-O-methyluridine-5'-phosphate
  modified_base (10)..(11): 2'-O-methylcytidine-5'-phosphate
  modified_base (14)..(15): 2'-O-methylcytidine-5'-phosphate
  modified_base (16)..(17): 2'-O-methyluridine-5'-phosphate
  modified_base (21)..(21): 2'-deoxy-thymidine-5'-phosphate-phosphorothioate
gananangnnngannnngatt

SEQ ID NO: 754 - DNA, 21 bp, Artificial Sequence
  Description of Artificial Sequence: Synthetic oligonucleotide
  modified_base (2)..(2): 2'-O-methylcytidine-5'-phosphate
  modified_base (12)..(12): 2'-O-methylcytidine-5'-phosphate
  modified_base (14)..(14): 2'-O-methyluridine-5'-phosphate
  modified_base (21)..(21): 2'-deoxy-thymidine-5'-phosphate-phosphorothioate
unaaggucggananauguctt

SEQ ID NO: 755 - DNA, 21 bp, Artificial Sequence
  Description of Artificial Sequence: Synthetic oligonucleotide
  modified_base (2)..(2): 2'-O-methylcytidine-5'-phosphate
  modified_base (3)..(3): 2'-O-methyluridine-5'-phosphate
  modified_base (4)..(5): 2'-O-methylcytidine-5'-phosphate
  modified_base (6)..(6): 2'-O-methyluridine-5'-phosphate
  modified_base (8)..(8): 2'-O-methylcytidine-5'-phosphate
  modified_base (9)..(9): 2'-O-methyluridine-5'-phosphate
  modified_base (12)..(12): 2'-O-methyluridine-5'-phosphate
  modified_base (13)..(13): 2'-O-methylcytidine-5'-phosphate
  modified_base (15)..(17): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
annnnnannaanngnnngntt

SEQ ID NO: 756 - DNA, 21 bp, Artificial Sequence
  Description of Artificial Sequence: Synthetic oligonucleotide
  modified_base (10)..(10): 2'-O-methyluridine-5'-phosphate
  modified_base (13)..(13): 2'-O-methyluridine-5'-phosphate
  modified_base (21)..(21): 2'-deoxy-thymidine-5'-phosphate-phosphorothioate
acgggcgaunagnaggagutt

SEQ ID NO: 757 - DNA, 21 bp, Artificial Sequence
  Description of Artificial Sequence: Synthetic oligonucleotide
  modified_base (1)..(1): 2'-O-methylcytidine-5'-phosphate
  modified_base (4)..(4): 2'-O-methylcytidine-5'-phosphate
  modified_base (7)..(7): 2'-O-methyluridine-5'-phosphate
  modified_base (12)..(13): 2'-O-methylcytidine-5'-phosphate
  modified_base (16)..(16): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
naanaangggannganaantt

SEQ ID NO: 758 - DNA, 21 bp, Artificial Sequence
  Description of Artificial Sequence: Synthetic oligonucleotide
  modified_base (12)..(12): 2'-O-methylcytidine-5'-phosphate
  modified_base (21)..(21): 2'-deoxy-thymidine-5'-phosphate-phosphorothioate
auugucgguccnauuguugtt

SEQ ID NO: 759 - DNA, 21 bp, Artificial Sequence
  Description of Artificial Sequence: Synthetic oligonucleotide
  modified_base (1)..(2): 2'-O-methylcytidine-5'-phosphate
  modified_base (3)..(3): 2'-O-methyluridine-5'-phosphate
  modified_base (4)..(4): 2'-O-methylcytidine-5'-phosphate
  modified_base (6)..(6): 2'-O-methylcytidine-5'-phosphate
  modified_base (10)..(10): 2'-O-methyluridine-5'-phosphate
  modified_base (12)..(12): 2'-O-methylcytidine-5'-phosphate
  modified_base (14)..(14): 2'-O-methylcytidine-5'-phosphate
  modified_base (16)..(17): 2'-O-methyluridine-5'-phosphate
  modified_base (18)..(19): 2'-O-methylcytidine-5'-phosphate
  modified_base (21)..(21): 2'-deoxy-thymidine-5'-phosphate-phosphorothioate
nnnnanaagngngngnnnntt

SEQ ID NO: 760 - DNA, 21 bp, Artificial Sequence
  Description of Artificial Sequence: Synthetic oligonucleotide
  modified_base (9)..(9): 2'-O-methylcytidine-5'-phosphate
  modified_base (21)..(21): 2'-deoxy-thymidine-5'-phosphate-phosphorothioate
ggaacgcgnacuugugaggtt

SEQ ID NO: 761 - DNA, 21 bp, Artificial Sequence
  Description of Artificial Sequence: Synthetic oligonucleotide
  modified_base (2)..(3): 2'-O-methylcytidine-5'-phosphate
  modified_base (5)..(5): 2'-O-methyluridine-5'-phosphate
  modified_base (6)..(6): 2'-O-methylcytidine-5'-phosphate
  modified_base (9)..(9): 2'-O-methyluridine-5'-phosphate
  modified_base (10)..(10): 2'-O-methylcytidine-5'-phosphate
  modified_base (17)..(17): 2'-O-methylcytidine-5'-phosphate
  modified_base (19)..(19): 2'-O-methylcytidine-5'-phosphate
  modified_base (21)..(21): 2'-deoxy-thymidine-5'-phosphate-phosphorothioate
anngnnaannaaggagngntt

SEQ ID NO: 762 - DNA, 21 bp, Artificial Sequence
  Description of Artificial Sequence: Synthetic oligonucleotide
  modified_base (21)..(21): 2'-deoxy-thymidine-5'-phosphate-phosphorothioate
gcgcuccuugauugacggutt

SEQ ID NO: 763 - DNA, 21 bp, Artificial Sequence
  Description of Artificial Sequence: Synthetic oligonucleotide
  modified_base (1)..(1): 2'-O-methylcytidine-5'-phosphate
  modified_base (2)..(2): 2'-O-methyluridine-5'-phosphate
  modified_base (4)..(4): 2'-O-methyluridine-5'-phosphate
  modified_base (5)..(5): 2'-O-methylcytidine-5'-phosphate
  modified_base (7)..(8): 2'-O-methyluridine-5'-phosphate
  modified_base (11)..(12): 2'-O-methyluridine-5'-phosphate
  modified_base (13)..(13): 2'-O-methylcytidine-5'-phosphate
  modified_base (16)..(16): 2'-O-methyluridine-5'-phosphate
  modified_base (17)..(18): 2'-O-methylcytidine-5'-phosphate
  modified_base (21)..(21): 2'-deoxy-thymidine-5'-phosphate-phosphorothioate
nngnngnngannngannnatt

SEQ ID NO: 764 - DNA, 21 bp, Artificial Sequence
  Description of Artificial Sequence: Synthetic oligonucleotide
  modified_base (11)..(11): 2'-O-methylcytidine-5'-phosphate
  modified_base (17)..(17): 2'-O-methylcytidine-5'-phosphate
  modified_base (21)..(21): 2'-deoxy-thymidine-5'-phosphate-phosphorothioate
uggaucgaaunaacganagtt

SEQ ID NO: 765 - DNA, 21 bp, Artificial Sequence
  Description of Artificial Sequence: Synthetic oligonucleotide
  modified_base (1)..(2): 2'-O-methyluridine-5'-phosphate
  modified_base (4)..(4): 2'-O-methyluridine-5'-phosphate
  modified_base (5)..(5): 2'-O-methylcytidine-5'-phosphate
  modified_base (6)..(7): 2'-O-methyluridine-5'-phosphate
  modified_base (11)..(11): 2'-O-methylcytidine-5'-phosphate
  modified_base (14)..(15): 2'-O-methylcytidine-5'-phosphate
  modified_base (16)..(16): 2'-O-methyluridine-5'-phosphate
  modified_base (17)..(17): 2'-O-methylcytidine-5'-phosphate
  modified_base (18)..(18): 2'-O-methyluridine-5'-phosphate
  modified_base (21)..(21): 2'-deoxy-thymidine-5'-phosphate-phosphorothioate
nngnnnnaagngannnnngtt

SEQ ID NO: 766 - DNA, 21 bp, Artificial Sequence
  Description of Artificial Sequence: Synthetic oligonucleotide
  modified_base (1)..(1): 2'-O-methylcytidine-5'-phosphate
  modified_base (12)..(12): 2'-O-methyluridine-5'-phosphate
  modified_base (17)..(17): 2'-O-methylcytidine-5'-phosphate
  modified_base (21)..(21): 2'-deoxy-thymidine-5'-phosphate-phosphorothioate
nagaggucgcunaaganaatt

SEQ ID NO: 767 - DNA, 21 bp, Artificial Sequence
  Description of Artificial Sequence: Synthetic oligonucleotide
  modified_base (1)..(3): 2'-O-methyluridine-5'-phosphate
  modified_base (6)..(7): 2'-O-methyluridine-5'-phosphate
  modified_base (11)..(13): 2'-O-methylcytidine-5'-phosphate
  modified_base (14)..(15): 2'-O-methyluridine-5'-phosphate
  modified_base (18)..(18): 2'-O-methylcytidine-5'-phosphate
  modified_base (21)..(21): 2'-deoxy-thymidine-5'-phosphate-phosphorothioate
nnnganngaannnnnagnatt

SEQ ID NO: 768 - DNA, 21 bp, Artificial Sequence
  Description of Artificial Sequence: Synthetic oligonucleotide
  modified_base (4)..(4): 2'-O-methyluridine-5'-phosphate
  modified_base (12)..(12): 2'-O-methylcytidine-5'-phosphate
  modified_base (16)..(16): 2'-O-methylcytidine-5'-phosphate
  modified_base (21)..(21): 2'-deoxy-thymidine-5'-phosphate-phosphorothioate
ugcnaaggguunaaunaaatt

SEQ ID NO: 769 - DNA, 21 bp, Artificial Sequence
  Description of Artificial Sequence: Synthetic oligonucleotide
  modified_base (3)..(3): 2'-O-methylcytidine-5'-phosphate
  modified_base (5)..(5): 2'-O-methyluridine-5'-phosphate
  modified_base (7)..(7): 2'-O-methylcytidine-5'-phosphate
  modified_base (11)..(11): 2'-O-methylcytidine-5'-phosphate
  modified_base (13)..(13): 2'-O-methylcytidine-5'-phosphate
  modified_base (16)..(16): 2'-O-methylcytidine-5'-phosphate
  modified_base (18)..(18): 2'-O-methyluridine-5'-phosphate
  modified_base (21)..(21): 2'-deoxy-thymidine-5'-phosphate-phosphorothioate
aanangngaananaangngtt

SEQ ID NO: 770 - DNA, 21 bp, Artificial Sequence
  Description of Artificial Sequence: Synthetic oligonucleotide
  modified_base (1)..(1): 2'-O-methylcytidine-5'-phosphate
  modified_base (14)..(14): 2'-O-methylcytidine-5'-phosphate
  modified_base (21)..(21): 2'-deoxy-thymidine-5'-phosphate-phosphorothioate
nacguuguguucgnauguutt

SEQ ID NO: 771 - DNA, 21 bp, Artificial Sequence
  Description of Artificial Sequence: Synthetic oligonucleotide
  modified_base (1)..(1): 2'-O-methyluridine-5'-phosphate
  modified_base (5)..(6): 2'-O-methylcytidine-5'-phosphate
  modified_base (9)..(9): 2'-O-methylcytidine-5'-phosphate
  modified_base (14)..(17): 2'-O-methyluridine-5'-phosphate
  modified_base (18)..(19): 2'-O-methylcytidine-5'-phosphate
  modified_base (21)..(21): 2'-deoxy-thymidine-5'-phosphate-phosphorothioate
ngggnnggngaaannnnnntt

SEQ ID NO: 772 - DNA, 21 bp, Artificial Sequence
  Description of Artificial Sequence: Synthetic oligonucleotide
  modified_base (18)..(18): 2'-O-methylcytidine-5'-phosphate
  modified_base (21)..(21): 2'-deoxy-thymidine-5'-phosphate-phosphorothioate
ggaaaauuucgccggccnatt

SEQ ID NO: 773 - DNA, 21 bp, Artificial Sequence
  Description of Artificial Sequence: Synthetic oligonucleotide
  modified_base (1)..(1): 2'-O-methylcytidine-5'-phosphate
  modified_base (3)..(4): 2'-O-methyluridine-5'-phosphate
  modified_base (7)..(8): 2'-O-methyluridine-5'-phosphate
  modified_base (9)..(9): 2'-O-methylcytidine-5'-phosphate
  modified_base (12)..(12): 2'-O-methyluridine-5'-phosphate
  modified_base (13)..(14): 2'-O-methylcytidine-5'-phosphate
  modified_base (17)..(17): 2'-O-methyluridine-5'-phosphate
  modified_base (19)..(19): 2'-O-methyluridine-5'-phosphate
  modified_base (21)..(21): 2'-deoxy-thymidine-5'-phosphate-phosphorothioate
ngnngannngannnaanantt

SEQ ID NO: 774 - DNA, 21 bp, Artificial Sequence
  Description of Artificial Sequence: Synthetic oligonucleotide
  modified_base (2)..(2): 2'-O-methyluridine-5'-phosphate
  modified_base (15)..(15): 2'-O-methylcytidine-5'-phosphate
  modified_base (21)..(21): 2'-deoxy-thymidine-5'-phosphate-phosphorothioate
anauuggaucgaaunaacgtt

SEQ ID NO: 775 - DNA, 21 bp, Artificial Sequence
  Description of Artificial Sequence: Synthetic oligonucleotide
  modified_base (2)..(2): 2'-O-methyluridine-5'-phosphate
  modified_base (4)..(4): 2'-O-methylcytidine-5'-phosphate
  modified_base (5)..(5): 2'-O-methyluridine-5'-phosphate
  modified_base (6)..(6): 2'-O-methylcytidine-5'-phosphate
  modified_base (7)..(7): 2'-O-methyluridine-5'-phosphate
  modified_base (9)..(9): 2'-O-methylcytidine-5'-phosphate
  modified_base (11)..(11): 2'-O-methyluridine-5'-phosphate
  modified_base (13)..(13): 2'-O-methyluridine-5'-phosphate
  modified_base (14)..(14): 2'-O-methylcytidine-5'-phosphate
  modified_base (16)..(16): 2'-O-methyluridine-5'-phosphate
  modified_base (21)..(21): 2'-deoxy-thymidine-5'-phosphate-phosphorothioate
angnnnnanangnngngaatt

SEQ ID NO: 776 - DNA, 21 bp, Artificial Sequence
  Description of Artificial Sequence: Synthetic oligonucleotide
  modified_base (3)..(3): 2'-O-methylcytidine-5'-phosphate
  modified_base (8)..(8): 2'-O-methylcytidine-5'-phosphate
  modified_base (12)..(12): 2'-O-methyluridine-5'-phosphate
  modified_base (17)..(17): 2'-O-methylcytidine-5'-phosphate
  modified_base (21)..(21): 2'-deoxy-thymidine-5'-phosphate-phosphorothioate
uunacganaugnagagnautt

SEQ ID NO: 777 - DNA, 21 bp, Artificial Sequence
  Description of Artificial Sequence: Synthetic oligonucleotide
  modified_base (5)..(5): 2'-O-methylcytidine-5'-phosphate
  modified_base (8)..(8): 2'-O-methyluridine-5'-phosphate
  modified_base (10)..(10): 2'-O-methylcytidine-5'-phosphate
  modified_base (13)..(13): 2'-O-methyluridine-5'-phosphate
  modified_base (14)..(14): 2'-O-methylcytidine-5'-phosphate
  modified_base (15)..(15): 2'-O-methyluridine-5'-phosphate
  modified_base (18)..(18): 2'-O-methyluridine-5'-phosphate
  modified_base (21)..(21): 2'-deoxy-thymidine-5'-phosphate-phosphorothioate
gggangananaannnaanatt

SEQ ID NO: 778 - DNA, 21 bp, Artificial Sequence
  Description of Artificial Sequence: Synthetic oligonucleotide
  modified_base (1)..(1): 2'-O-methyluridine-5'-phosphate
  modified_base (4)..(4): 2'-O-methyluridine-5'-phosphate
  modified_base (11)..(11): 2'-O-methyluridine-5'-phosphate
  modified_base (21)..(21): 2'-deoxy-thymidine-5'-phosphate-phosphorothioate
naunagauugnaucguccctt

SEQ ID NO: 779 - DNA, 21 bp, Artificial Sequence
  Description of Artificial Sequence: Synthetic oligonucleotide
  modified_base (2)..(4): 2'-O-methylcytidine-5'-phosphate
  modified_base (7)..(7): 2'-O-methylcytidine-5'-phosphate
  modified_base (11)..(11): 2'-O-methyluridine-5'-phosphate
  modified_base (12)..(12): 2'-O-methylcytidine-5'-phosphate
  modified_base (15)..(15): 2'-O-methylcytidine-5'-phosphate
  modified_base (18)..(18): 2'-O-methyluridine-5'-phosphate
  modified_base (21)..(21): 2'-deoxy-thymidine-5'-phosphate-phosphorothioate
annnganaaannggnaangtt

SEQ ID NO: 780 - DNA, 21 bp, Artificial Sequence
  Description of Artificial Sequence: Synthetic oligonucleotide
  modified_base (1)..(1): 2'-O-methylcytidine-5'-phosphate
  modified_base (21)..(21): 2'-deoxy-thymidine-5'-phosphate-phosphorothioate
nauugccgauuugucgggutt

SEQ ID NO: 781 - DNA, 21 bp, Artificial Sequence
  Description of Artificial Sequence: Synthetic oligonucleotide
  modified_base (2)..(2): 2'-O-methyluridine-5'-phosphate
  modified_base (3)..(3): 2'-O-methylcytidine-5'-phosphate
  modified_base (4)..(4): 2'-O-methyluridine-5'-phosphate
  modified_base (7)..(7): 2'-O-methyluridine-5'-phosphate
  modified_base (9)..(9): 2'-O-methyluridine-5'-phosphate
  modified_base (10)..(10): 2'-O-methylcytidine-5'-phosphate
  modified_base (12)..(14): 2'-O-methylcytidine-5'-phosphate
  modified_base (21)..(21): 2'-deoxy-thymidine-5'-phosphate-phosphorothioate
annnaananngnnnaaaaatt

SEQ ID NO: 782 - DNA, 21 bp, Artificial Sequence
  Description of Artificial Sequence: Synthetic oligonucleotide
  modified_base (12)..(12): 2'-O-methyluridine-5'-phosphate
  modified_base (15)..(15): 2'-O-methyluridine-5'-phosphate
  modified_base (21)..(21): 2'-deoxy-thymidine-5'-phosphate-phosphorothioate
uuuuugggcganaunagautt

SEQ ID NO: 783 - DNA, 21 bp, Artificial Sequence
  Description of Artificial Sequence: Synthetic oligonucleotide
  modified_base (1)..(1): 2'-O-methyluridine-5'-phosphate
  modified_base (2)..(2): 2'-O-methylcytidine-5'-phosphate
  modified_base (3)..(4): 2'-O-methyluridine-5'-phosphate
  modified_base (8)..(8): 2'-O-methylcytidine-5'-phosphate
  modified_base (11)..(12): 2'-O-methylcytidine-5'-phosphate
  modified_base (13)..(13): 2'-O-methyluridine-5'-phosphate
  modified_base (14)..(14): 2'-O-methylcytidine-5'-phosphate
  modified_base (15)..(15): 2'-O-methyluridine-5'-phosphate
  modified_base (17)..(17): 2'-O-methyluridine-5'-phosphate
  modified_base (21)..(21): 2'-deoxy-thymidine-5'-phosphate-phosphorothioate
nnnnaagngannnnngnaatt

SEQ ID NO: 784 - DNA, 21 bp, Artificial Sequence
  Description of Artificial Sequence: Synthetic oligonucleotide
  modified_base (2)..(2): 2'-O-methyluridine-5'-phosphate
  modified_base (4)..(4): 2'-O-methylcytidine-5'-phosphate
  modified_base (15)..(15): 2'-O-methyluridine-5'-phosphate
  modified_base (21)..(21): 2'-deoxy-thymidine-5'-phosphate-phosphorothioate
unanagaggucgcunaagatt

SEQ ID NO: 785 - DNA, 21 bp, Artificial Sequence
  Description of Artificial Sequence: Synthetic oligonucleotide
  modified_base (1)..(1): 2'-O-methyluridine-5'-phosphate
  modified_base (3)..(3): 2'-O-methylcytidine-5'-phosphate
  modified_base (7)..(7): 2'-O-methylcytidine-5'-phosphate
  modified_base (9)..(9): 2'-O-methylcytidine-5'-phosphate
  modified_base (12)..(12): 2'-O-methylcytidine-5'-phosphate
  modified_base (14)..(14): 2'-O-methyluridine-5'-phosphate
  modified_base (16)..(16): 2'-O-methyluridine-5'-phosphate
  modified_base (17)..(17): 2'-O-methylcytidine-5'-phosphate
  modified_base (21)..(21): 2'-deoxy-thymidine-5'-phosphate-phosphorothioate
ngngaananaangngnnaatt

SEQ ID NO: 786 - DNA, 21 bp, Artificial Sequence
  Description of Artificial Sequence: Synthetic oligonucleotide
  modified_base (5)..(5): 2'-O-methylcytidine-5'-phosphate
  modified_base (18)..(18): 2'-O-methylcytidine-5'-phosphate
  modified_base (21)..(21): 2'-deoxy-thymidine-5'-phosphate-phosphorothioate
uuganacguuguguucgnatt

SEQ ID NO: 787 - DNA, 21 bp, Artificial Sequence
  Description of Artificial Sequence: Synthetic oligonucleotide
  modified_base (2)..(2): 2'-O-methyluridine-5'-phosphate
  modified_base (5)..(5): 2'-O-methylcytidine-5'-phosphate
  modified_base (6)..(6): 2'-O-methyluridine-5'-phosphate
  modified_base (7)..(7): 2'-O-methylcytidine-5'-phosphate
  modified_base (11)..(11): 2'-O-methylcytidine-5'-phosphate
  modified_base (12)..(12): 2'-O-methyluridine-5'-phosphate
  modified_base (15)..(15): 2'-O-methylcytidine-5'-phosphate
  modified_base (17)..(17): 2'-O-methyluridine-5'-phosphate
  modified_base (21)..(21): 2'-deoxy-thymidine-5'-phosphate-phosphorothioate
anaannngaannaananggtt

SEQ ID NO: 788 - DNA, 21 bp, Artificial Sequence
  Description of Artificial Sequence: Synthetic oligonucleotide
  modified_base (2)..(2): 2'-O-methylcytidine-5'-phosphate
  modified_base (7)..(7): 2'-O-methyluridine-5'-phosphate
  modified_base (17)..(17): 2'-O-methyluridine-5'-phosphate
  modified_base (21)..(21): 2'-deoxy-thymidine-5'-phosphate-phosphorothioate
cnaugunaguucgagunautt

SEQ ID NO: 789 - DNA, 21 bp, Artificial Sequence
  Description of Artificial Sequence: Synthetic oligonucleotide
  modified_base (1)..(1): 2'-O-methylcytidine-5'-phosphate
  modified_base (2)..(2): 2'-O-methyluridine-5'-phosphate
  modified_base (4)..(4): 2'-O-methylcytidine-5'-phosphate
  modified_base (9)..(9): 2'-O-methylcytidine-5'-phosphate
  modified_base (12)..(12): 2'-O-methyluridine-5'-phosphate
  modified_base (14)..(14): 2'-O-methylcytidine-5'-phosphate
  modified_base (17)..(17): 2'-O-methyluridine-5'-phosphate
  modified_base (18)..(18): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
nnangggangananaannntt

SEQ ID NO: 790 - DNA, 21 bp, Artificial Sequence
  Description of Artificial Sequence: Synthetic oligonucleotide
  modified_base (7)..(7): 2'-O-methyluridine-5'-phosphate
  modified_base (17)..(17): 2'-O-methyluridine-5'-phosphate
  modified_base (21)..(21): 2'-deoxy-thymidine-5'-phosphate-phosphorothioate
agauugnaucgucccgnagtt

SEQ ID NO: 791 - DNA, 21 bp, Artificial Sequence
  Description of Artificial Sequence: Synthetic oligonucleotide
  modified_base (1)..(1): 2'-O-methyluridine-5'-phosphate
  modified_base (4)..(4): 2'-O-methylcytidine-5'-phosphate
  modified_base (5)..(5): 2'-O-methyluridine-5'-phosphate
  modified_base (6)..(6): 2'-O-methylcytidine-5'-phosphate
  modified_base (10)..(10): 2'-O-methylcytidine-5'-phosphate
  modified_base (11)..(11): 2'-O-methyluridine-5'-phosphate
  modified_base (14)..(14): 2'-O-methylcytidine-5'-phosphate
  modified_base (16)..(16): 2'-O-methyluridine-5'-phosphate
  modified_base (21)..(21): 2'-deoxy-thymidine-5'-phosphate-phosphorothioate
naannngaannaanangggtt

SEQ ID NO: 792 - DNA, 21 bp, Artificial Sequence
  Description of Artificial Sequence: Synthetic oligonucleotide
  modified_base (3)..(3): 2'-O-methylcytidine-5'-phosphate
  modified_base (8)..(8): 2'-O-methyluridine-5'-phosphate
  modified_base (18)..(18): 2'-O-methyluridine-5'-phosphate
  modified_base (21)..(21): 2'-deoxy-thymidine-5'-phosphate-phosphorothioate
ccnaugunaguucgagunatt

SEQ ID NO: 793 - DNA, 21 bp, Artificial Sequence
  Description of Artificial Sequence: Synthetic oligonucleotide
  modified_base (1)..(1): 2'-O-methylcytidine-5'-phosphate
  modified_base (4)..(5): 2'-O-methyluridine-5'-phosphate
  modified_base (14)..(14): 2'-O-methyluridine-5'-phosphate
  modified_base (17)..(17): 2'-O-methylcytidine-5'-phosphate
  modified_base (18)..(19): 2'-O-methyluridine-5'-phosphate
  modified_base (21)..(21): 2'-deoxy-thymidine-5'-phosphate-phosphorothioate
nagnnagagggagnagnnntt

SEQ ID NO: 794 - DNA, 21 bp, Artificial Sequence
  Description of Artificial Sequence: Synthetic oligonucleotide
  modified_base (5)..(5): 2'-O-methyluridine-5'-phosphate
  modified_base (14)..(14): 2'-O-methyluridine-5'-phosphate
  modified_base (21)..(21): 2'-deoxy-thymidine-5'-phosphate-phosphorothioate
aagcnacucccucnaacugtt

SEQ ID NO: 795 - DNA, 21 bp, Artificial Sequence
  Description of Artificial Sequence: Synthetic oligonucleotide
  modified_base (2)..(2): 2'-O-methyluridine-5'-phosphate
  modified_base (4)..(4): 2'-O-methyluridine-5'-phosphate
  modified_base (8)..(10): 2'-O-methyluridine-5'-phosphate
  modified_base (12)..(12): 2'-O-methylcytidine-5'-phosphate
  modified_base (15)..(15): 2'-O-methylcytidine-5'-phosphate
  modified_base (17)..(18): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
anangagnnnanagnannntt

SEQ ID NO: 796 - DNA, 21 bp, Artificial Sequence
  Description of Artificial Sequence: Synthetic oligonucleotide
  modified_base (9)..(9): 2'-O-methyluridine-5'-phosphate
  modified_base (15)..(15): 2'-O-methylcytidine-5'-phosphate
  modified_base (17)..(17): 2'-O-methyluridine-5'-phosphate
  modified_base (21)..(21): 2'-deoxy-thymidine-5'-phosphate-phosphorothioate
aggugcugnaaacunanautt

SEQ ID NO: 797 - DNA, 21 bp, Artificial Sequence
  Description of Artificial Sequence: Synthetic oligonucleotide
  modified_base (2)..(2): 2'-O-methyluridine-5'-phosphate
  modified_base (6)..(8): 2'-O-methyluridine-5'-phosphate
  modified_base (10)..(10): 2'-O-methylcytidine-5'-phosphate
  modified_base (13)..(13): 2'-O-methylcytidine-5'-phosphate
  modified_base (15)..(16): 2'-O-methylcytidine-5'-phosphate
  modified_base (17)..(19): 2'-O-methyluridine-5'-phosphate
  modified_base (21)..(21): 2'-deoxy-thymidine-5'-phosphate-phosphorothioate
angagnnnanagnannnnntt

SEQ ID NO: 798 - DNA, 21 bp, Artificial Sequence
  Description of Artificial Sequence: Synthetic oligonucleotide
  modified_base (11)..(11): 2'-O-methyluridine-5'-phosphate
  modified_base (17)..(17): 2'-O-methylcytidine-5'-phosphate
  modified_base (21)..(21): 2'-deoxy-thymidine-5'-phosphate-phosphorothioate
aaaggugcugnaaacunautt

SEQ ID NO: 799 - DNA, 21 bp, Artificial Sequence
  Description of Artificial Sequence: Synthetic oligonucleotide
  modified_base (1)..(1): 2'-O-methyluridine-5'-phosphate
  modified_base (5)..(5): 2'-O-methyluridine-5'-phosphate
  modified_base (7)..(7): 2'-O-methylcytidine-5'-phosphate
  modified_base (9)..(10): 2'-O-methyluridine-5'-phosphate
  modified_base (12)..(12): 2'-O-methyluridine-5'-phosphate
  modified_base (14)..(14): 2'-O-methylcytidine-5'-phosphate
  modified_base (17)..(17): 2'-O-methyluridine-5'-phosphate
  modified_base (18)..(19): 2'-O-methylcytidine-5'-phosphate
  modified_base (21)..(21): 2'-deoxy-thymidine-5'-phosphate-phosphorothioate
nggangnannananaannntt

SEQ ID NO: 800 - DNA, 21 bp, Artificial Sequence
  Description of Artificial Sequence: Synthetic oligonucleotide
  modified_base (7)..(7): 2'-O-methyluridine-5'-phosphate
  modified_base (9)..(9): 2'-O-methyluridine-5'-phosphate
  modified_base (14)..(14): 2'-O-methylcytidine-5'-phosphate
  modified_base (18)..(18): 2'-O-methylcytidine-5'-phosphate
  modified_base (21)..(21): 2'-deoxy-thymidine-5'-phosphate-phosphorothioate
ggauugnanaaugnaucnatt

SEQ ID NO: 801 - DNA, 21 bp, Artificial Sequence
  Description of Artificial Sequence: Synthetic oligonucleotide
  modified_base (2)..(3): 2'-O-methylcytidine-5'-phosphate
  modified_base (4)..(5): 2'-O-methyluridine-5'-phosphate
  modified_base (9)..(9): 2'-O-methylcytidine-5'-phosphate
  modified_base (14)..(14): 2'-O-methylcytidine-5'-phosphate
  modified_base (21)..(21): 2'-deoxy-thymidine-5'-phosphate-phosphorothioate
annnngganggagngaaaatt

SEQ ID NO: 802 - DNA, 21 bp, Artificial Sequence
  Description of Artificial Sequence: Synthetic oligonucleotide
  modified_base (14)..(14): 2'-O-methylcytidine-5'-phosphate
  modified_base (21)..(21): 2'-deoxy-thymidine-5'-phosphate-phosphorothioate
uuuucgcuccgucnaaggutt

SEQ ID NO: 803 - DNA, 21 bp, Artificial Sequence
  Description of Artificial Sequence: Synthetic oligonucleotide
  modified_base (1)..(1): 2'-O-methylcytidine-5'-phosphate
  modified_base (3)..(5): 2'-O-methyluridine-5'-phosphate
  modified_base (6)..(8): 2'-O-methylcytidine-5'-phosphate
  modified_base (12)..(13): 2'-O-methylcytidine-5'-phosphate
  modified_base (16)..(16): 2'-O-methyluridine-5'-phosphate
  modified_base (17)..(17): 2'-O-methylcytidine-5'-phosphate
  modified_base (18)..(18): 2'-O-methyluridine-5'-phosphate
  modified_base (21)..(21): 2'-deoxy-thymidine-5'-phosphate-phosphorothioate
nannnnnngggnngannnatt

SEQ ID NO: 804 - DNA, 21 bp, Artificial Sequence
  Description of Artificial Sequence: Synthetic oligonucleotide
  modified_base (1)..(1): 2'-O-methyluridine-5'-phosphate
  modified_base (21)..(21): 2'-deoxy-thymidine-5'-phosphate-phosphorothioate
nagaucggcccgggaaaugtt

SEQ ID NO: 805 - DNA, 21 bp, Artificial Sequence
  Description of Artificial Sequence: Synthetic oligonucleotide
  modified_base (1)..(1): 2'-O-methyluridine-5'-phosphate
  modified_base (3)..(4): 2'-O-methyluridine-5'-phosphate
  modified_base (6)..(7): 2'-O-methyluridine-5'-phosphate
  modified_base (10)..(12): 2'-O-methylcytidine-5'-phosphate
  modified_base (14)..(14): 2'-O-methyluridine-5'-phosphate
  modified_base (16)..(16): 2'-O-methyluridine-5'-phosphate
  modified_base (19)..(19): 2'-O-methyluridine-5'-phosphate
  modified_base (21)..(21): 2'-deoxy-thymidine-5'-phosphate-phosphorothioate
ngnngnngannngnangantt

SEQ ID NO: 806 - DNA, 21 bp, Artificial Sequence
  Description of Artificial Sequence: Synthetic oligonucleotide
  modified_base (3)..(3): 2'-O-methylcytidine-5'-phosphate
  modified_base (5)..(5): 2'-O-methyluridine-5'-phosphate
  modified_base (12)..(12): 2'-O-methylcytidine-5'-phosphate
  modified_base (15)..(15): 2'-O-methylcytidine-5'-phosphate
  modified_base (18)..(18): 2'-O-methylcytidine-5'-phosphate
  modified_base (21)..(21): 2'-deoxy-thymidine-5'-phosphate-phosphorothioate
aunanacgggunaanaanatt

SEQ ID NO: 807 - DNA, 21 bp, Artificial Sequence
  Description of Artificial Sequence: Synthetic oligonucleotide
  modified_base (2)..(4): 2'-O-methyluridine-5'-phosphate
  modified_base (6)..(7): 2'-O-methylcytidine-5'-phosphate
  modified_base (8)..(8): 2'-O-methyluridine-5'-phosphate
  modified_base (14)..(15): 2'-O-methylcytidine-5'-phosphate
  modified_base (16)..(16): 2'-O-methyluridine-5'-phosphate
  modified_base (18)..(18): 2'-O-methylcytidine-5'-phosphate
  modified_base (21)..(21): 2'-deoxy-thymidine-5'-phosphate-phosphorothioate
gnnnannngagagnnnanatt

SEQ ID NO: 808 - DNA, 21 bp, Artificial Sequence
  Description of Artificial Sequence: Synthetic oligonucleotide
  modified_base (3)..(3): 2'-O-methyluridine-5'-phosphate
  modified_base (11)..(11): 2'-O-methylcytidine-5'-phosphate
  modified_base (15)..(15): 2'-O-methyluridine-5'-phosphate
  modified_base (21)..(21): 2'-deoxy-thymidine-5'-phosphate-phosphorothioate
ugnaggcucunaggnaaactt

SEQ ID NO: 809 - DNA, 21 bp, Artificial Sequence
  Description of Artificial Sequence: Synthetic oligonucleotide
  modified_base (2)..(2): 2'-O-methylcytidine-5'-phosphate
  modified_base (5)..(5): 2'-O-methylcytidine-5'-phosphate
  modified_base (7)..(7): 2'-O-methyluridine-5'-phosphate
  modified_base (11)..(11): 2'-O-methyluridine-5'-phosphate
  modified_base (15)..(15): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
anaanangganaaangggntt

SEQ ID NO: 810 - DNA, 21 bp, Artificial Sequence
  Description of Artificial Sequence: Synthetic oligonucleotide
  modified_base (8)..(8): 2'-O-methyluridine-5'-phosphate
  modified_base (12)..(12): 2'-O-methylcytidine-5'-phosphate
  modified_base (21)..(21): 2'-deoxy-thymidine-5'-phosphate-phosphorothioate
acccguunaucnauguugutt

SEQ ID NO: 811 - DNA, 21 bp, Artificial Sequence
  Description of Artificial Sequence: Synthetic oligonucleotide
  modified_base (3)..(3): 2'-O-methyluridine-5'-phosphate
  modified_base (5)..(6): 2'-O-methyluridine-5'-phosphate
  modified_base (8)..(9): 2'-O-methyluridine-5'-phosphate
  modified_base (12)..(14): 2'-O-methylcytidine-5'-phosphate
  modified_base (16)..(16): 2'-O-methyluridine-5'-phosphate
  modified_base (18)..(18): 2'-O-methyluridine-5'-phosphate
  modified_base (21)..(21): 2'-deoxy-thymidine-5'-phosphate-phosphorothioate
ggngnngnngannngnangtt

SEQ ID NO: 812 - DNA, 21 bp, Artificial Sequence
  Description of Artificial Sequence: Synthetic oligonucleotide
  modified_base (1)..(1): 2'-O-methylcytidine-5'-phosphate
  modified_base (3)..(3): 2'-O-methyluridine-5'-phosphate
  modified_base (10)..(10): 2'-O-methylcytidine-5'-phosphate
  modified_base (13)..(13): 2'-O-methylcytidine-5'-phosphate
  modified_base (16)..(16): 2'-O-methylcytidine-5'-phosphate
  modified_base (21)..(21): 2'-deoxy-thymidine-5'-phosphate-phosphorothioate
nanacgggunaanaanacctt

SEQ ID NO: 813 - DNA, 21 bp, Artificial Sequence
  Description of Artificial Sequence: Synthetic oligonucleotide
  modified_base (4)..(4): 2'-O-methylcytidine-5'-phosphate
  modified_base (9)..(9): 2'-O-methylcytidine-5'-phosphate
  modified_base (18)..(18): 2'-O-methyluridine-5'-phosphate
  modified_base (21)..(21): 2'-deoxy-thymidine-5'-phosphate-phosphorothioate
gganggagngaaaaaggngtt

SEQ ID NO: 814 - DNA, 21 bp, Artificial Sequence
  Description of Artificial Sequence: Synthetic oligonucleotide
  modified_base (1)..(1): 2'-O-methylcytidine-5'-phosphate
  modified_base (21)..(21): 2'-deoxy-thymidine-5'-phosphate-phosphorothioate
naccuuuuucgcuccgucctt

SEQ ID NO: 815 - DNA, 21 bp, Artificial Sequence
  Description of Artificial Sequence: Synthetic oligonucleotide
  modified_base (4)..(4): 2'-O-methylcytidine-5'-phosphate
  modified_base (8)..(8): 2'-O-methyluridine-5'-phosphate
  modified_base (15)..(16): 2'-O-methyluridine-5'-phosphate
  modified_base (17)..(17): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
aaangggngagaggnnnantt

SEQ ID NO: 816 - DNA, 21 bp, Artificial Sequence
  Description of Artificial Sequence: Synthetic oligonucleotide
  modified_base (11)..(11): 2'-O-methylcytidine-5'-phosphate
  modified_base (21)..(21): 2'-deoxy-thymidine-5'-phosphate-phosphorothioate
augaaccucunacccguuutt

SEQ ID NO: 817 - DNA, 21 bp, Artificial Sequence
  Description of Artificial Sequence: Synthetic oligonucleotide
  modified_base (3)..(3): 2'-O-methylcytidine-5'-phosphate
  modified_base (4)..(4): 2'-O-methyluridine-5'-phosphate
  modified_base (6)..(6): 2'-O-methylcytidine-5'-phosphate
  modified_base (12)..(13): 2'-O-methyluridine-5'-phosphate
  modified_base (14)..(14): 2'-O-methylcytidine-5'-phosphate
  modified_base (17)..(17): 2'-O-methylcytidine-5'-phosphate
  modified_base (18)..(18): 2'-O-methyluridine-5'-phosphate
  modified_base (21)..(21): 2'-deoxy-thymidine-5'-phosphate-phosphorothioate
gannangaggannnggnngtt

SEQ ID NO: 818 - DNA, 21 bp, Artificial Sequence
  Description of Artificial Sequence: Synthetic oligonucleotide
  modified_base (1)..(1): 2'-O-methylcytidine-5'-phosphate
  modified_base (15)..(15): 2'-O-methyluridine-5'-phosphate
  modified_base (21)..(21): 2'-deoxy-thymidine-5'-phosphate-phosphorothioate
nagccgaauccucgnaguctt

SEQ ID NO: 819 - DNA, 21 bp, Artificial Sequence
  Description of Artificial Sequence: Synthetic oligonucleotide
  modified_base (4)..(4): 2'-O-methyluridine-5'-phosphate
  modified_base (8)..(8): 2'-O-methylcytidine-5'-phosphate
  modified_base (12)..(12): 2'-O-methyluridine-5'-phosphate
  modified_base (19)..(19): 2'-O-methyluridine-5'-phosphate
  modified_base (21)..(21): 2'-deoxy-thymidine-5'-phosphate-phosphorothioate
gganaaangggngagaggntt

SEQ ID NO: 820 - DNA, 21 bp, Artificial Sequence
  Description of Artificial Sequence: Synthetic oligonucleotide
  modified_base (7)..(7): 2'-O-methylcytidine-5'-phosphate
  modified_base (15)..(15): 2'-O-methyluridine-5'-phosphate
  modified_base (21)..(21): 2'-deoxy-thymidine-5'-phosphate-phosphorothioate
accucunacccguunaucctt

SEQ ID NO: 821 - DNA, 21 bp, Artificial Sequence
  Description of Artificial Sequence: Synthetic oligonucleotide
  modified_base (1)..(2): 2'-O-methyluridine-5'-phosphate
  modified_base (4)..(4): 2'-O-methyluridine-5'-phosphate
  modified_base (5)..(5): 2'-O-methylcytidine-5'-phosphate
  modified_base (7)..(8): 2'-O-methylcytidine-5'-phosphate
  modified_base (9)..(9): 2'-O-methyluridine-5'-phosphate
  modified_base (12)..(12): 2'-O-methyluridine-5'-phosphate
  modified_base (16)..(16): 2'-O-methyluridine-5'-phosphate
  modified_base (19)..(19): 2'-O-methyluridine-5'-phosphate
  modified_base (21)..(21): 2'-deoxy-thymidine-5'-phosphate-phosphorothioate
nnannannnaangagngantt

SEQ ID NO: 822 - DNA, 21 bp, Artificial Sequence
  Description of Artificial Sequence: Synthetic oligonucleotide
  modified_base (3)..(3): 2'-O-methylcytidine-5'-phosphate
  modified_base (7)..(7): 2'-O-methylcytidine-5'-phosphate
  modified_base (10)..(10): 2'-O-methyluridine-5'-phosphate
  modified_base (17)..(17): 2'-O-methyluridine-5'-phosphate
  modified_base (21)..(21): 2'-deoxy-thymidine-5'-phosphate-phosphorothioate
aunacunaunagguganaatt

SEQ ID NO: 823 - DNA, 21 bp, Artificial Sequence
  Description of Artificial Sequence: Synthetic oligonucleotide
  modified_base (2)..(2): 2'-O-methyluridine-5'-phosphate
  modified_base (6)..(6): 2'-O-methylcytidine-5'-phosphate
  modified_base (10)..(10): 2'-O-methyluridine-5'-phosphate
  modified_base (17)..(18): 2'-O-methyluridine-5'-phosphate
  modified_base (19)..(19): 2'-O-methylcytidine-5'-phosphate
  modified_base (21)..(21): 2'-deoxy-thymidine-5'-phosphate-phosphorothioate
anaaangggngagaggnnntt

SEQ ID NO: 824 - DNA, 21 bp, Artificial Sequence
  Description of Artificial Sequence: Synthetic oligonucleotide
  modified_base (9)..(9): 2'-O-methylcytidine-5'-phosphate
  modified_base (17)..(17): 2'-O-methyluridine-5'-phosphate
  modified_base (21)..(21): 2'-deoxy-thymidine-5'-phosphate-phosphorothioate
gaaccucunacccguunautt

SEQ ID NO: 825 - DNA, 21 bp, Artificial Sequence
  Description of Artificial Sequence: Synthetic oligonucleotide
  modified_base (1)..(1): 2'-O-methyluridine-5'-phosphate
  modified_base (2)..(3): 2'-O-methylcytidine-5'-phosphate
  modified_base (4)..(4): 2'-O-methyluridine-5'-phosphate
  modified_base (7)..(7): 2'-O-methylcytidine-5'-phosphate
  modified_base (8)..(8): 2'-O-methyluridine-5'-phosphate
  modified_base (10)..(10): 2'-O-methylcytidine-5'-phosphate
  modified_base (16)..(17): 2'-O-methyluridine-5'-phosphate
  modified_base (18)..(18): 2'-O-methylcytidine-5'-phosphate
  modified_base (21)..(21): 2'-deoxy-thymidine-5'-phosphate-phosphorothioate
nnnngannangaggannngtt

SEQ ID NO: 826 - DNA, 21 bp, Artificial Sequence
  Description of Artificial Sequence: Synthetic oligonucleotide
  modified_base (11)..(11): 2'-O-methyluridine-5'-phosphate
  modified_base (15)..(15): 2'-O-methylcytidine-5'-phosphate
  modified_base (21)..(21): 2'-deoxy-thymidine-5'-phosphate-phosphorothioate
cgaauccucgnagunaggatt

SEQ ID NO: 827 - DNA, 21 bp, Artificial Sequence
  Description of Artificial Sequence: Synthetic oligonucleotide
  modified_base (3)..(3): 2'-O-methyluridine-5'-phosphate
  modified_base (7)..(7): 2'-O-methylcytidine-5'-phosphate
  modified_base (11)..(11): 2'-O-methyluridine-5'-phosphate
  modified_base (18)..(19): 2'-O-methyluridine-5'-phosphate
  modified_base (21)..(21): 2'-deoxy-thymidine-5'-phosphate-phosphorothioate
ganaaangggngagaggnntt

SEQ ID NO: 828 - DNA, 21 bp, Artificial Sequence
  Description of Artificial Sequence: Synthetic oligonucleotide
  modified_base (8)..(8): 2'-O-methylcytidine-5'-phosphate
  modified_base (16)..(16): 2'-O-methyluridine-5'-phosphate
  modified_base (21)..(21): 2'-deoxy-thymidine-5'-phosphate-phosphorothioate
aaccucunacccguunauctt

SEQ ID NO: 829 - DNA, 21 bp, Artificial Sequence
  Description of Artificial Sequence: Synthetic oligonucleotide
  modified_base (3)..(4): 2'-O-methylcytidine-5'-phosphate
  modified_base (5)..(6): 2'-O-methyluridine-5'-phosphate
  modified_base (10)..(10): 2'-O-methylcytidine-5'-phosphate
  modified_base (15)..(15): 2'-O-methylcytidine-5'-phosphate
  modified_base (21)..(21): 2'-deoxy-thymidine-5'-phosphate-phosphorothioate
gannnngganggagngaaatt

SEQ ID NO: 830 - DNA, 21 bp, Artificial Sequence
  Description of Artificial Sequence: Synthetic oligonucleotide
  modified_base (13)..(13): 2'-O-methylcytidine-5'-phosphate
  modified_base (21)..(21): 2'-deoxy-thymidine-5'-phosphate-phosphorothioate
uuucgcuccgucnaagguctt

SEQ ID NO: 831 - DNA, 21 bp, Artificial Sequence
  Description of Artificial Sequence: Synthetic oligonucleotide
  modified_base (9)..(9): 2'-O-methyluridine-5'-phosphate
  modified_base (11)..(12): 2'-O-methylcytidine-5'-phosphate
  modified_base (17)..(18): 2'-O-methyluridine-5'-phosphate
  modified_base (21)..(21): 2'-deoxy-thymidine-5'-phosphate-phosphorothioate
gaaaaaggngnnggagnngtt

SEQ ID NO: 832 - DNA, 21 bp, Artificial Sequence
  Description of Artificial Sequence: Synthetic oligonucleotide
  modified_base (1)..(1): 2'-O-methylcytidine-5'-phosphate
  modified_base (10)..(10): 2'-O-methylcytidine-5'-phosphate
  modified_base (21)..(21): 2'-deoxy-thymidine-5'-phosphate-phosphorothioate
naacuccggnaccuuuuuctt

SEQ ID NO: 833 - DNA, 21 bp, Artificial Sequence
  Description of Artificial Sequence: Synthetic oligonucleotide
  modified_base (2)..(2): 2'-O-methyluridine-5'-phosphate
  modified_base (3)..(4): 2'-O-methylcytidine-5'-phosphate
  modified_base (5)..(5): 2'-O-methyluridine-5'-phosphate
  modified_base (8)..(8): 2'-O-methylcytidine-5'-phosphate
  modified_base (9)..(9): 2'-O-methyluridine-5'-phosphate
  modified_base (11)..(11): 2'-O-methylcytidine-5'-phosphate
  modified_base (17)..(18): 2'-O-methyluridine-5'-phosphate
  modified_base (19)..(19): 2'-O-methylcytidine-5'-phosphate
  modified_base (21)..(21): 2'-deoxy-thymidine-5'-phosphate-phosphorothioate
annnngannangaggannntt

SEQ ID NO: 834 - DNA, 21 bp, Artificial Sequence
  Description of Artificial Sequence: Synthetic oligonucleotide
  modified_base (10)..(10): 2'-O-methyluridine-5'-phosphate
  modified_base (14)..(14): 2'-O-methylcytidine-5'-phosphate
  modified_base (21)..(21): 2'-deoxy-thymidine-5'-phosphate-phosphorothioate
gaauccucgnagunaggautt

SEQ ID NO: 835 - DNA, 21 bp, Artificial Sequence
  Description of Artificial Sequence: Synthetic oligonucleotide
  modified_base (3)..(3): 2'-O-methyluridine-5'-phosphate
  modified_base (4)..(5): 2'-O-methylcytidine-5'-phosphate
  modified_base (8)..(9): 2'-O-methylcytidine-5'-phosphate
  modified_base (10)..(11): 2'-O-methyluridine-5'-phosphate
  modified_base (15)..(15): 2'-O-methylcytidine-5'-phosphate
  modified_base (21)..(21): 2'-deoxy-thymidine-5'-phosphate-phosphorothioate
gannngannnngganggagtt

SEQ ID NO: 836 - DNA, 21 bp, Artificial Sequence
  Description of Artificial Sequence: Synthetic oligonucleotide
  modified_base (8)..(8): 2'-O-methylcytidine-5'-phosphate
  modified_base (21)..(21): 2'-deoxy-thymidine-5'-phosphate-phosphorothioate
cuccgucnaaggucggauctt

SEQ ID NO: 837 - DNA, 21 bp, Artificial Sequence
  Description of Artificial Sequence: Synthetic oligonucleotide
  modified_base (1)..(3): 2'-O-methylcytidine-5'-phosphate
  modified_base (7)..(8): 2'-O-methylcytidine-5'-phosphate
  modified_base (11)..(11): 2'-O-methyluridine-5'-phosphate
  modified_base (12)..(12): 2'-O-methylcytidine-5'-phosphate
  modified_base (13)..(13): 2'-O-methyluridine-5'-phosphate
  modified_base (15)..(15): 2'-O-methyluridine-5'-phosphate
  modified_base (18)..(18): 2'-O-methyluridine-5'-phosphate
  modified_base (21)..(21): 2'-deoxy-thymidine-5'-phosphate-phosphorothioate
nnngggnngannnangangtt

SEQ ID NO: 838 - DNA, 21 bp, Artificial Sequence
  Description of Artificial Sequence: Synthetic oligonucleotide
  modified_base (1)..(1): 2'-O-methylcytidine-5'-phosphate
  modified_base (4)..(4): 2'-O-methylcytidine-5'-phosphate
  modified_base (6)..(6): 2'-O-methyluridine-5'-phosphate
  modified_base (21)..(21): 2'-deoxy-thymidine-5'-phosphate-phosphorothioate
naunanagaucggcccgggtt

SEQ ID NO: 839 - DNA, 21 bp, Artificial Sequence
  Description of Artificial Sequence: Synthetic oligonucleotide
  modified_base (2)..(3): 2'-O-methylcytidine-5'-phosphate
  modified_base (6)..(6): 2'-O-methylcytidine-5'-phosphate
  modified_base (11)..(11): 2'-O-methyluridine-5'-phosphate
  modified_base (13)..(14): 2'-O-methylcytidine-5'-phosphate
  modified_base (16)..(16): 2'-O-methylcytidine-5'-phosphate
  modified_base (17)..(17): 2'-O-methyluridine-5'-phosphate
  modified_base (21)..(21): 2'-deoxy-thymidine-5'-phosphate-phosphorothioate
annggnaaaananngnnaatt

SEQ ID NO: 840 - DNA, 21 bp, Artificial Sequence
  Description of Artificial Sequence: Synthetic oligonucleotide
  modified_base (2)..(2): 2'-O-methyluridine-5'-phosphate
  modified_base (8)..(8): 2'-O-methyluridine-5'-phosphate
  modified_base (21)..(21): 2'-deoxy-thymidine-5'-phosphate-phosphorothioate
unagcggnauuuugccggutt

SEQ ID NO: 841 - DNA, 21 bp, Artificial Sequence
  Description of Artificial Sequence: Synthetic oligonucleotide
  modified_base (3)..(4): 2'-O-methylcytidine-5'-phosphate
  modified_base (7)..(7): 2'-O-methylcytidine-5'-phosphate
  modified_base (12)..(12): 2'-O-methyluridine-5'-phosphate
  modified_base (14)..(15): 2'-O-methylcytidine-5'-phosphate
  modified_base (17)..(17): 2'-O-methylcytidine-5'-phosphate
  modified_base (18)..(18): 2'-O-methyluridine-5'-phosphate
  modified_base (21)..(21): 2'-deoxy-thymidine-5'-phosphate-phosphorothioate
gannggnaaaananngnnatt

SEQ ID NO: 842 - DNA, 21 bp, Artificial Sequence
  Description of Artificial Sequence: Synthetic oligonucleotide
  modified_base (1)..(1): 2'-O-methyluridine-5'-phosphate
  modified_base (7)..(7): 2'-O-methyluridine-5'-phosphate
  modified_base (21)..(21): 2'-deoxy-thymidine-5'-phosphate-phosphorothioate
nagcggnauuuugccgguctt

SEQ ID NO: 843 - DNA, 21 bp, Artificial Sequence
  Description of Artificial Sequence: Synthetic oligonucleotide
  modified_base (2)..(2): 2'-O-methyluridine-5'-phosphate
  modified_base (3)..(3): 2'-O-methylcytidine-5'-phosphate
  modified_base (5)..(5): 2'-O-methylcytidine-5'-phosphate
  modified_base (6)..(6): 2'-O-methyluridine-5'-phosphate
  modified_base (13)..(13): 2'-O-methyluridine-5'-phosphate
  modified_base (14)..(14): 2'-O-methylcytidine-5'-phosphate
  modified_base (18)..(18): 2'-O-methyluridine-5'-phosphate
  modified_base (21)..(21): 2'-deoxy-thymidine-5'-phosphate-phosphorothioate
annannagaaggnngagnatt

SEQ ID NO: 844 - DNA, 21 bp, Artificial Sequence
  Description of Artificial Sequence: Synthetic oligonucleotide
  modified_base (1)..(1): 2'-O-methyluridine-5'-phosphate
  modified_base (13)..(13): 2'-O-methyluridine-5'-phosphate
  modified_base (21)..(21): 2'-deoxy-thymidine-5'-phosphate-phosphorothioate
nacucgaccuucnagugautn

SEQ ID NO: 845 - DNA, 21 bp, Artificial Sequence
  Description of Artificial Sequence: Synthetic oligonucleotide
  modified_base (2)..(2): 2'-O-methyluridine-5'-phosphate
  modified_base (4)..(4): 2'-O-methyluridine-5'-phosphate
  modified_base (5)..(5): 2'-O-methylcytidine-5'-phosphate
  modified_base (7)..(7): 2'-O-methyluridine-5'-phosphate
  modified_base (8)..(10): 2'-O-methylcytidine-5'-phosphate
  modified_base (11)..(11): 2'-O-methyluridine-5'-phosphate
  modified_base (15)..(15): 2'-O-methyluridine-5'-phosphate
  modified_base (16)..(16): 2'-O-methylcytidine-5'-phosphate
  modified_base (18)..(18): 2'-O-methylcytidine-5'-phosphate
  modified_base (21)..(21): 2'-deoxy-thymidine-5'-phosphate-phosphorothioate
anannannnnngaanngnatt

SEQ ID NO: 846 - DNA, 21 bp, Artificial Sequence
  Description of Artificial Sequence: Synthetic oligonucleotide
  modified_base (8)..(8): 2'-O-methylcytidine-5'-phosphate
  modified_base (17)..(17): 2'-O-methyluridine-5'-phosphate
  modified_base (21)..(21): 2'-deoxy-thymidine-5'-phosphate-phosphorothioate
ugcgauunagggauganautt

SEQ ID NO: 847 - DNA, 21 bp, Artificial Sequence
  Description of Artificial Sequence: Synthetic oligonucleotide
  modified_base (1)..(2): 2'-O-methylcytidine-5'-phosphate
  modified_base (4)..(4): 2'-O-methyluridine-5'-phosphate
  modified_base (5)..(5): 2'-O-methylcytidine-5'-phosphate
  modified_base (7)..(8): 2'-O-methyluridine-5'-phosphate
  modified_base (10)..(10): 2'-O-methyluridine-5'-phosphate
  modified_base (12)..(12): 2'-O-methylcytidine-5'-phosphate
  modified_base (18)..(18): 2'-O-methyluridine-5'-phosphate
  modified_base (21)..(21): 2'-deoxy-thymidine-5'-phosphate-phosphorothioate
nnannanngnangaggangtt

SEQ ID NO: 848 - DNA, 21 bp, Artificial Sequence
  Description of Artificial Sequence: Synthetic oligonucleotide
  modified_base (1)..(1): 2'-O-methylcytidine-5'-phosphate
  modified_base (9)..(9): 2'-O-methyluridine-5'-phosphate
  modified_base (11)..(11): 2'-O-methylcytidine-5'-phosphate
  modified_base (21)..(21): 2'-deoxy-thymidine-5'-phosphate-phosphorothioate
nauccucgnanaaugauggtt

SEQ ID NO: 849 - DNA, 21 bp, Artificial Sequence
  Description of Artificial Sequence: Synthetic oligonucleotide
  modified_base (3)..(4): 2'-O-methyluridine-5'-phosphate
  modified_base (11)..(11): 2'-O-methyluridine-5'-phosphate
  modified_base (12)..(13): 2'-O-methylcytidine-5'-phosphate
  modified_base (17)..(17): 2'-O-methylcytidine-5'-phosphate
  modified_base (21)..(21): 2'-deoxy-thymidine-5'-phosphate-phosphorothioate
aanngaaagannngaanggtt

SEQ ID NO: 850 - DNA, 21 bp, Artificial Sequence
  Description of Artificial Sequence: Synthetic oligonucleotide
  modified_base (15)..(15): 2'-O-methylcytidine-5'-phosphate
  modified_base (21)..(21): 2'-deoxy-thymidine-5'-phosphate-phosphorothioate
ccguucggaucuuunaauutt

SEQ ID NO: 851 - DNA, 21 bp, Artificial Sequence
  Description of Artificial Sequence: Synthetic oligonucleotide
  modified_base (8)..(10): 2'-O-methyluridine-5'-phosphate
  modified_base (11)..(11): 2'-O-methylcytidine-5'-phosphate
  modified_base (15)..(15): 2'-O-methylcytidine-5'-phosphate
  modified_base (18)..(19): 2'-O-methylcytidine-5'-phosphate
  modified_base (21)..(21): 2'-deoxy-thymidine-5'-phosphate-phosphorothioate
aggaaaannnngggnganntt

SEQ ID NO: 852 - DNA, 21 bp, Artificial Sequence
  Description of Artificial Sequence: Synthetic oligonucleotide
  modified_base (13)..(15): 2'-O-methyluridine-5'-phosphate
  modified_base (21)..(21): 2'-deoxy-thymidine-5'-phosphate-phosphorothioate
ggucgcccgaaannnuccutt

SEQ ID NO: 853 - DNA, 21 bp, Artificial Sequence
  Description of Artificial Sequence: Synthetic oligonucleotide
  modified_base (2)..(2): 2'-O-methyluridine-5'-phosphate
  modified_base (6)..(6): 2'-O-methylcytidine-5'-phosphate
  modified_base (7)..(7): 2'-O-methyluridine-5'-phosphate
  modified_base (8)..(8): 2'-O-methylcytidine-5'-phosphate
  modified_base (10)..(13): 2'-O-methyluridine-5'-phosphate
  modified_base (15)..(15): 2'-O-methylcytidine-5'-phosphate
  modified_base (18)..(18): 2'-O-methyluridine-5'-phosphate
  modified_base (21)..(21): 2'-deoxy-thymidine-5'-phosphate-phosphorothioate
gnaagnnnannnngngangtt

SEQ ID NO: 854 - DNA, 21 bp, Artificial Sequence
  Description of Artificial Sequence: Synthetic oligonucleotide
  modified_base (1)..(1): 2'-O-methylcytidine-5'-phosphate
  modified_base (6)..(6): 2'-O-methylcytidine-5'-phosphate
  modified_base (17)..(17): 2'-O-methyluridine-5'-phosphate
  modified_base (21)..(21): 2'-deoxy-thymidine-5'-phosphate-phosphorothioate
naucgnaaaaugagcunactt

SEQ ID NO: 855 - DNA, 21 bp, Artificial Sequence
  Description of Artificial Sequence: Synthetic oligonucleotide
  modified_base (5)..(7): 2'-O-methyluridine-5'-phosphate
  modified_base (8)..(8): 2'-O-methylcytidine-5'-phosphate
  modified_base (12)..(12): 2'-O-methylcytidine-5'-phosphate
  modified_base (15)..(16): 2'-O-methylcytidine-5'-phosphate
  modified_base (17)..(18): 2'-O-methyluridine-5'-phosphate
  modified_base (21)..(21): 2'-deoxy-thymidine-5'-phosphate-phosphorothioate
aaaannnngggngannnnatt

SEQ ID NO: 856 - DNA, 21 bp, Artificial Sequence
  Description of Artificial Sequence: Synthetic oligonucleotide
  modified_base (1)..(1): 2'-O-methyluridine-5'-phosphate
  modified_base (21)..(21): 2'-deoxy-thymidine-5'-phosphate-phosphorothioate
naaggucgcccgaaauuuutt

SEQ ID NO: 857 - DNA, 21 bp, Artificial Sequence
  Description of Artificial Sequence: Synthetic oligonucleotide
  modified_base (1)..(1): 2'-O-methylcytidine-5'-phosphate
  modified_base (5)..(7): 2'-O-methylcytidine-5'-phosphate
  modified_base (9)..(9): 2'-O-methyluridine-5'-phosphate
  modified_base (10)..(10): 2'-O-methylcytidine-5'-phosphate
  modified_base (12)..(13): 2'-O-methyluridine-5'-phosphate
  modified_base (15)..(15): 2'-O-methyluridine-5'-phosphate
  modified_base (17)..(17): 2'-O-methylcytidine-5'-phosphate
  modified_base (21)..(21): 2'-deoxy-thymidine-5'-phosphate-phosphorothioate
naggnnnannanngnangatt

SEQ ID NO: 858 - DNA, 21 bp, Artificial Sequence
  Description of Artificial Sequence: Synthetic oligonucleotide
  modified_base (4)..(4): 2'-O-methyluridine-5'-phosphate
  modified_base (6)..(6): 2'-O-methylcytidine-5'-phosphate
  modified_base (21)..(21): 2'-deoxy-thymidine-5'-phosphate-phosphorothioate
ucgnanaaugaugggccugtt

SEQ ID NO: 859 - DNA, 21 bp, Artificial Sequence
  Description of Artificial Sequence: Synthetic oligonucleotide
  modified_base (1)..(3): 2'-O-methylcytidine-5'-phosphate
  modified_base (6)..(6): 2'-O-methyluridine-5'-phosphate
  modified_base (9)..(10): 2'-O-methylcytidine-5'-phosphate
  modified_base (12)..(13): 2'-O-methyluridine-5'-phosphate
  modified_base (15)..(16): 2'-O-methyluridine-5'-phosphate
  modified_base (19)..(19): 2'-O-methyluridine-5'-phosphate
  modified_base (21)..(21): 2'-deoxy-thymidine-5'-phosphate-phosphorothioate
nnnganaannannannagntt

SEQ ID NO: 860 - DNA, 21 bp, Artificial Sequence
  Description of Artificial Sequence: Synthetic oligonucleotide
  modified_base (3)..(3): 2'-O-methyluridine-5'-phosphate
  modified_base (6)..(6): 2'-O-methyluridine-5'-phosphate
  modified_base (13)..(13): 2'-O-methyluridine-5'-phosphate
  modified_base (21)..(21): 2'-deoxy-thymidine-5'-phosphate-phosphorothioate
acnaanaauggunaucgggtt

SEQ ID NO: 861 - DNA, 21 bp, Artificial Sequence
  Description of Artificial Sequence: Synthetic oligonucleotide
  modified_base (2)..(2): 2'-O-methyluridine-5'-phosphate
  modified_base (3)..(3): 2'-O-methylcytidine-5'-phosphate
  modified_base (5)..(5): 2'-O-methyluridine-5'-phosphate
  modified_base (6)..(8): 2'-O-methylcytidine-5'-phosphate
  modified_base (9)..(9): 2'-O-methyluridine-5'-phosphate
  modified_base (13)..(13): 2'-O-methyluridine-5'-phosphate
  modified_base (14)..(14): 2'-O-methylcytidine-5'-phosphate
  modified_base (16)..(16): 2'-O-methylcytidine-5'-phosphate
  modified_base (19)..(19): 2'-O-methylcytidine-5'-phosphate
  modified_base (21)..(21): 2'-deoxy-thymidine-5'-phosphate-phosphorothioate
annannnnngaanngnagntt

SEQ ID NO: 862 - DNA, 21 bp, Artificial Sequence
  Description of Artificial Sequence: Synthetic oligonucleotide
  modified_base (10)..(10): 2'-O-methylcytidine-5'-phosphate
  modified_base (21)..(21): 2'-deoxy-thymidine-5'-phosphate-phosphorothioate
gcugcgauunagggaugautt

SEQ ID NO: 863 - DNA, 21 bp, Artificial Sequence
  Description of Artificial Sequence: Synthetic oligonucleotide
  modified_base (1)..(1): 2'-O-methyluridine-5'-phosphate
  modified_base (10)..(12): 2'-O-methyluridine-5'-phosphate
  modified_base (13)..(13): 2'-O-methylcytidine-5'-phosphate
  modified_base (17)..(17): 2'-O-methylcytidine-5'-phosphate
  modified_base (21)..(21): 2'-deoxy-thymidine-5'-phosphate-phosphorothioate
ngaggaaaannnngggngatt

SEQ ID NO: 864 - DNA, 21 bp, Artificial Sequence
  Description of Artificial Sequence: Synthetic oligonucleotide
  modified_base (18)..(18): 2'-O-methylcytidine-5'-phosphate
  modified_base (21)..(21): 2'-deoxy-thymidine-5'-phosphate-phosphorothioate
ucgcccgaaauuuuccunatt

SEQ ID NO: 865 - DNA, 21 bp, Artificial Sequence
  Description of Artificial Sequence: Synthetic oligonucleotide
  modified_base (4)..(5): 2'-O-methyluridine-5'-phosphate
  modified_base (12)..(12): 2'-O-methyluridine-5'-phosphate
  modified_base (13)..(14): 2'-O-methylcytidine-5'-phosphate
  modified_base (18)..(18): 2'-O-methylcytidine-5'-phosphate
  modified_base (21)..(21): 2'-deoxy-thymidine-5'-phosphate-phosphorothioate
aaanngaaagannngaangtt

SEQ ID NO: 866 - DNA, 21 bp, Artificial Sequence
  Description of Artificial Sequence: Synthetic oligonucleotide
  modified_base (14)..(14): 2'-O-methylcytidine-5'-phosphate
  modified_base (21)..(21): 2'-deoxy-thymidine-5'-phosphate-phosphorothioate
cguucggaucuuunaauuutt

SEQ ID NO: 867 - DNA, 21 bp, Artificial Sequence
  Description of Artificial Sequence: Synthetic oligonucleotide
  modified_base (2)..(2): 2'-O-methyluridine-5'-phosphate
  modified_base (3)..(4): 2'-O-methylcytidine-5'-phosphate
  modified_base (5)..(5): 2'-O-methyluridine-5'-phosphate
  modified_base (8)..(8): 2'-O-methyluridine-5'-phosphate
  modified_base (9)..(9): 2'-O-methylcytidine-5'-phosphate
  modified_base (12)..(13): 2'-O-methyluridine-5'-phosphate
  modified_base (16)..(16): 2'-O-methyluridine-5'-phosphate
  modified_base (19)..(19): 2'-O-methyluridine-5'-phosphate
  modified_base (21)..(21): 2'-deoxy-thymidine-5'-phosphate-phosphorothioate
annnnaannaannganaantt

SEQ ID NO: 868 - DNA, 21 bp, Artificial Sequence
  Description of Artificial Sequence: Synthetic oligonucleotide
  modified_base (3)..(3): 2'-O-methyluridine-5'-phosphate
  modified_base (6)..(6): 2'-O-methylcytidine-5'-phosphate
  modified_base (14)..(14): 2'-O-methyluridine-5'-phosphate
  modified_base (21)..(21): 2'-deoxy-thymidine-5'-phosphate-phosphorothioate
aunaunaauugaunaggautt

SEQ ID NO: 869 - DNA, 21 bp, Artificial Sequence
  Description of Artificial Sequence: Synthetic oligonucleotide
  modified_base (2)..(2): 2'-O-methyluridine-5'-phosphate
  modified_base (3)..(3): 2'-O-methylcytidine-5'-phosphate
  modified_base (6)..(6): 2'-O-methyluridine-5'-phosphate
  modified_base (12)..(13): 2'-O-methyluridine-5'-phosphate
  modified_base (17)..(17): 2'-O-methyluridine-5'-phosphate
  modified_base (18)..(18): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
annganagaggnngggnnntt

SEQ ID NO: 870 - DNA, 21 bp, Artificial Sequence
  Description of Artificial Sequence: Synthetic oligonucleotide
  modified_base (6)..(6): 2'-O-methylcytidine-5'-phosphate
  modified_base (13)..(13): 2'-O-methyluridine-5'-phosphate
  modified_base (21)..(21): 2'-deoxy-thymidine-5'-phosphate-phosphorothioate
agaccnaaccucnaucgautt

SEQ ID NO: 871 - DNA, 21 bp, Artificial Sequence
  Description of Artificial Sequence: Synthetic oligonucleotide
  modified_base (2)..(2): 2'-O-methylcytidine-5'-phosphate
  modified_base (5)..(6): 2'-O-methyluridine-5'-phosphate
  modified_base (8)..(8): 2'-O-methyluridine-5'-phosphate
  modified_base (10)..(10): 2'-O-methylcytidine-5'-phosphate
  modified_base (11)..(11): 2'-O-methyluridine-5'-phosphate
  modified_base (12)..(12): 2'-O-methylcytidine-5'-phosphate
  modified_base (14)..(14): 2'-O-methylcytidine-5'-phosphate
  modified_base (16)..(16): 2'-O-methyluridine-5'-phosphate
  modified_base (17)..(17): 2'-O-methylcytidine-5'-phosphate
  modified_base (18)..(19): 2'-O-methyluridine-5'-phosphate
  modified_base (21)..(21): 2'-deoxy-thymidine-5'-phosphate-phosphorothioate
gnaannangnnngnannnntt

SEQ ID NO: 872 - DNA, 21 bp, Artificial Sequence
  Description of Artificial Sequence: Synthetic oligonucleotide
  modified_base (11)..(11): 2'-O-methylcytidine-5'-phosphate
  modified_base (13)..(13): 2'-O-methyluridine-5'-phosphate
  modified_base (21)..(21): 2'-deoxy-thymidine-5'-phosphate-phosphorothioate
aagaugcgagnanaauugctt

SEQ ID NO: 873 - DNA, 21 bp, Artificial Sequence
  Description of Artificial Sequence: Synthetic oligonucleotide
  modified_base (5)..(5): 2'-O-methyluridine-5'-phosphate
  modified_base (7)..(7): 2'-O-methyluridine-5'-phosphate
  modified_base (9)..(9): 2'-O-methylcytidine-5'-phosphate
  modified_base (10)..(10): 2'-O-methyluridine-5'-phosphate
  modified_base (13)..(13): 2'-O-methyluridine-5'-phosphate
  modified_base (14)..(14): 2'-O-methylcytidine-5'-phosphate
  modified_base (18)..(18): 2'-O-methyluridine-5'-phosphate
  modified_base (19)..(19): 2'-O-methylcytidine-5'-phosphate
  modified_base (21)..(21): 2'-deoxy-thymidine-5'-phosphate-phosphorothioate
aaaangnannaanngggnntt

SEQ ID NO: 874 - DNA, 21 bp, Artificial Sequence
  Description of Artificial Sequence: Synthetic oligonucleotide
  modified_base (9)..(9): 2'-O-methyluridine-5'-phosphate
  modified_base (12)..(12): 2'-O-methyluridine-5'-phosphate
  modified_base (14)..(14): 2'-O-methylcytidine-5'-phosphate
  modified_base (21)..(21): 2'-deoxy-thymidine-5'-phosphate-phosphorothioate
gacccgaunagnanauuuutt

SEQ ID NO: 875 - DNA, 21 bp, Artificial Sequence
  Description of Artificial Sequence: Synthetic oligonucleotide
  modified_base (4)..(4): 2'-O-methyluridine-5'-phosphate
  modified_base (6)..(6): 2'-O-methyluridine-5'-phosphate
  modified_base (8)..(8): 2'-O-methylcytidine-5'-phosphate
  modified_base (9)..(9): 2'-O-methyluridine-5'-phosphate
  modified_base (12)..(12): 2'-O-methyluridine-5'-phosphate
  modified_base (13)..(13): 2'-O-methylcytidine-5'-phosphate
  modified_base (17)..(17): 2'-O-methyluridine-5'-phosphate
  modified_base (18)..(18): 2'-O-methylcytidine-5'-phosphate
  modified_base (21)..(21): 2'-deoxy-thymidine-5'-phosphate-phosphorothioate
aaangnannaanngggnnatt

SEQ ID NO: 876 - DNA, 21 bp, Artificial Sequence
  Description of Artificial Sequence: Synthetic oligonucleotide
  modified_base (10)..(10): 2'-O-methyluridine-5'-phosphate
  modified_base (13)..(13): 2'-O-methyluridine-5'-phosphate
  modified_base (15)..(15): 2'-O-methylcytidine-5'-phosphate
  modified_base (21)..(21): 2'-deoxy-thymidine-5'-phosphate-phosphorothioate
ugacccgaunagnanauuutt

SEQ ID NO: 877 - DNA, 21 bp, Artificial Sequence
  Description of Artificial Sequence: Synthetic oligonucleotide
  modified_base (3)..(4): 2'-O-methyluridine-5'-phosphate
  modified_base (6)..(7): 2'-O-methylcytidine-5'-phosphate
  modified_base (9)..(9): 2'-O-methylcytidine-5'-phosphate
  modified_base (10)..(10): 2'-O-methyluridine-5'-phosphate
  modified_base (11)..(11): 2'-O-methylcytidine-5'-phosphate
  modified_base (16)..(17): 2'-O-methyluridine-5'-phosphate
  modified_base (19)..(19): 2'-O-methylcytidine-5'-phosphate
  modified_base (21)..(21): 2'-deoxy-thymidine-5'-phosphate-phosphorothioate
ggnngnnannnggaanngntt

SEQ ID NO: 878 - DNA, 21 bp, Artificial Sequence
  Description of Artificial Sequence: Synthetic oligonucleotide
  modified_base (2)..(2): 2'-O-methylcytidine-5'-phosphate
  modified_base (15)..(15): 2'-O-methylcytidine-5'-phosphate
  modified_base (21)..(21): 2'-deoxy-thymidine-5'-phosphate-phosphorothioate
gnaauuccgaguggnaacctt

SEQ ID NO: 879 - DNA, 21 bp, Artificial Sequence
  Description of Artificial Sequence: Synthetic oligonucleotide
  modified_base (1)..(1): 2'-O-methyluridine-5'-phosphate
  modified_base (2)..(2): 2'-O-methylcytidine-5'-phosphate
  modified_base (4)..(4): 2'-O-methylcytidine-5'-phosphate
  modified_base (6)..(6): 2'-O-methyluridine-5'-phosphate
  modified_base (7)..(7): 2'-O-methylcytidine-5'-phosphate
  modified_base (8)..(9): 2'-O-methyluridine-5'-phosphate
  modified_base (11)..(11): 2'-O-methyluridine-5'-phosphate
  modified_base (13)..(13): 2'-O-methylcytidine-5'-phosphate
  modified_base (16)..(16): 2'-O-methyluridine-5'-phosphate
  modified_base (17)..(17): 2'-O-methylcytidine-5'-phosphate
  modified_base (19)..(19): 2'-O-methylcytidine-5'-phosphate
  modified_base (21)..(21): 2'-deoxy-thymidine-5'-phosphate-phosphorothioate
nngnannnnanangannantt

SEQ ID NO: 880 - DNA, 21 bp, Artificial Sequence
  Description of Artificial Sequence: Synthetic oligonucleotide
  modified_base (8)..(8): 2'-O-methyluridine-5'-phosphate
  modified_base (10)..(10): 2'-O-methyluridine-5'-phosphate
  modified_base (21)..(21): 2'-deoxy-thymidine-5'-phosphate-phosphorothioate
gugaucgnanaagaugcgatt

SEQ ID NO: 881 - DNA, 21 bp, Artificial Sequence
  Description of Artificial Sequence: Synthetic oligonucleotide
  modified_base (2)..(2): 2'-O-methylcytidine-5'-phosphate
  modified_base (4)..(4): 2'-O-methyluridine-5'-phosphate
  modified_base (5)..(5): 2'-O-methylcytidine-5'-phosphate
  modified_base (6)..(7): 2'-O-methyluridine-5'-phosphate
  modified_base (9)..(9): 2'-O-methyluridine-5'-phosphate
  modified_base (11)..(11): 2'-O-methylcytidine-5'-phosphate
  modified_base (14)..(14): 2'-O-methyluridine-5'-phosphate
  modified_base (15)..(15): 2'-O-methylcytidine-5'-phosphate
  modified_base (17)..(19): 2'-O-methylcytidine-5'-phosphate
  modified_base (21)..(21): 2'-deoxy-thymidine-5'-phosphate-phosphorothioate
gnannnnanangannannntt

SEQ ID NO: 882 - DNA, 21 bp, Artificial Sequence
  Description of Artificial Sequence: Synthetic oligonucleotide
  modified_base (10)..(10): 2'-O-methyluridine-5'-phosphate
  modified_base (12)..(12): 2'-O-methyluridine-5'-phosphate
  modified_base (21)..(21): 2'-deoxy-thymidine-5'-phosphate-phosphorothioate
gggugaucgnanaagaugctt

SEQ ID NO: 883 - DNA, 21 bp, Artificial Sequence
  Description of Artificial Sequence: Synthetic oligonucleotide
  modified_base (2)..(2): 2'-O-methyluridine-5'-phosphate
  modified_base (5)..(5): 2'-O-methylcytidine-5'-phosphate
  modified_base (8)..(8): 2'-O-methylcytidine-5'-phosphate
  modified_base (9)..(9): 2'-O-methyluridine-5'-phosphate
  modified_base (10)..(10): 2'-O-methylcytidine-5'-phosphate
  modified_base (13)..(13): 2'-O-methyluridine-5'-phosphate
  modified_base (14)..(14): 2'-O-methylcytidine-5'-phosphate
  modified_base (17)..(17): 2'-O-methylcytidine-5'-phosphate
  modified_base (18)..(19): 2'-O-methyluridine-5'-phosphate
  modified_base (21)..(21): 2'-deoxy-thymidine-5'-phosphate-phosphorothioate
anagnaannnaanngannntt

SEQ ID NO: 884 - DNA, 21 bp, Artificial Sequence
  Description of Artificial Sequence: Synthetic oligonucleotide
  modified_base (17)..(17): 2'-O-methyluridine-5'-phosphate
  modified_base (21)..(21): 2'-deoxy-thymidine-5'-phosphate-phosphorothioate
aagucgauugaguugcnautt

SEQ ID NO: 885 - DNA, 21 bp, Artificial Sequence
  Description of Artificial Sequence: Synthetic oligonucleotide
  modified_base (2)..(2): 2'-O-methylcytidine-5'-phosphate
  modified_base (3)..(3): 2'-O-methyluridine-5'-phosphate
  modified_base (4)..(4): 2'-O-methylcytidine-5'-phosphate
  modified_base (7)..(7): 2'-O-methyluridine-5'-phosphate
  modified_base (8)..(8): 2'-O-methylcytidine-5'-phosphate
  modified_base (11)..(11): 2'-O-methylcytidine-5'-phosphate
  modified_base (12)..(15): 2'-O-methyluridine-5'-phosphate
  modified_base (21)..(21): 2'-deoxy-thymidine-5'-phosphate-phosphorothioate
annnaanngannnnnaggatt

SEQ ID NO: 886 - DNA, 21 bp, Artificial Sequence
  Description of Artificial Sequence: Synthetic oligonucleotide
  modified_base (4)..(4): 2'-O-methyluridine-5'-phosphate
  modified_base (21)..(21): 2'-deoxy-thymidine-5'-phosphate-phosphorothioate
uccnaaaagucgauugagutt

SEQ ID NO: 887 - DNA, 21 bp, Artificial Sequence
  Description of Artificial Sequence: Synthetic oligonucleotide
  modified_base (1)..(1): 2'-O-methyluridine-5'-phosphate
  modified_base (3)..(3): 2'-O-methyluridine-5'-phosphate
  modified_base (5)..(5): 2'-O-methylcytidine-5'-phosphate
  modified_base (6)..(6): 2'-O-methyluridine-5'-phosphate
  modified_base (9)..(9): 2'-O-methyluridine-5'-phosphate
  modified_base (10)..(10): 2'-O-methylcytidine-5'-phosphate
  modified_base (14)..(14): 2'-O-methyluridine-5'-phosphate
  modified_base (15)..(15): 2'-O-methylcytidine-5'-phosphate
  modified_base (21)..(21): 2'-deoxy-thymidine-5'-phosphate-phosphorothioate
ngnannaanngggnnaaggtt

SEQ ID NO: 888 - DNA, 21 bp, Artificial Sequence
  Description of Artificial Sequence: Synthetic oligonucleotide
  modified_base (13)..(13): 2'-O-methyluridine-5'-phosphate
  modified_base (16)..(16): 2'-O-methyluridine-5'-phosphate
  modified_base (18)..(18): 2'-O-methylcytidine-5'-phosphate
  modified_base (21)..(21): 2'-deoxy-thymidine-5'-phosphate-phosphorothioate
ccuugacccgaunagnanatt

SEQ ID NO: 889 - DNA, 21 bp, Artificial Sequence
  Description of Artificial Sequence: Synthetic oligonucleotide
  modified_base (2)..(2): 2'-O-methylcytidine-5'-phosphate
  modified_base (4)..(4): 2'-O-methyluridine-5'-phosphate
  modified_base (6)..(6): 2'-O-methylcytidine-5'-phosphate
  modified_base (8)..(8): 2'-O-methyluridine-5'-phosphate
  modified_base (12)..(12): 2'-O-methylcytidine-5'-phosphate
  modified_base (15)..(15): 2'-O-methyluridine-5'-phosphate
  modified_base (16)..(17): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
anangnanaagngannnantt

SEQ ID NO: 890 - DNA, 21 bp, Artificial Sequence
  Description of Artificial Sequence: Synthetic oligonucleotide
  modified_base (11)..(11): 2'-O-methyluridine-5'-phosphate
  modified_base (15)..(15): 2'-O-methylcytidine-5'-phosphate
  modified_base (21)..(21): 2'-deoxy-thymidine-5'-phosphate-phosphorothioate
auggaucgcunaugnaugutt

SEQ ID NO: 891 - DNA, 21 bp, Artificial Sequence
  Description of Artificial Sequence: Synthetic oligonucleotide
  modified_base (3)..(3): 2'-O-methylcytidine-5'-phosphate
  modified_base (6)..(6): 2'-O-methyluridine-5'-phosphate
  modified_base (7)..(8): 2'-O-methylcytidine-5'-phosphate
  modified_base (10)..(10): 2'-O-methyluridine-5'-phosphate
  modified_base (12)..(12): 2'-O-methylcytidine-5'-phosphate
  modified_base (13)..(14): 2'-O-methyluridine-5'-phosphate
  modified_base (15)..(15): 2'-O-methylcytidine-5'-phosphate
  modified_base (17)..(19): 2'-O-methylcytidine-5'-phosphate
  modified_base (21)..(21): 2'-deoxy-thymidine-5'-phosphate-phosphorothioate
agngannnanannnngnnntt

SEQ ID NO: 892 - DNA, 21 bp, Artificial Sequence
  Description of Artificial Sequence: Synthetic oligonucleotide
  modified_base (9)..(9): 2'-O-methyluridine-5'-phosphate
  modified_base (21)..(21): 2'-deoxy-thymidine-5'-phosphate-phosphorothioate
gggcgaagnauggaucgcutt

SEQ ID NO: 893 - DNA, 21 bp, Artificial Sequence
  Description of Artificial Sequence: Synthetic oligonucleotide
  modified_base (4)..(4): 2'-O-methyluridine-5'-phosphate
  modified_base (5)..(7): 2'-O-methylcytidine-5'-phosphate
  modified_base (8)..(8): 2'-O-methyluridine-5'-phosphate
  modified_base (10)..(12): 2'-O-methyluridine-5'-phosphate
  modified_base (15)..(16): 2'-O-methyluridine-5'-phosphate
  modified_base (18)..(19): 2'-O-methylcytidine-5'-phosphate
  modified_base (21)..(21): 2'-deoxy-thymidine-5'-phosphate-phosphorothioate
aaannnnnannnggnngnntt

SEQ ID NO: 894 - DNA, 21 bp, Artificial Sequence
  Description of Artificial Sequence: Synthetic oligonucleotide
  modified_base (3)..(3): 2'-O-methylcytidine-5'-phosphate
  modified_base (7)..(7): 2'-O-methylcytidine-5'-phosphate
  modified_base (11)..(11): 2'-O-methyluridine-5'-phosphate
  modified_base (21)..(21): 2'-deoxy-thymidine-5'-phosphate-phosphorothioate
ggnaacnaaanagggauuutt

SEQ ID NO: 895 - DNA, 21 bp, Artificial Sequence
  Description of Artificial Sequence: Synthetic oligonucleotide
  modified_base (2)..(2): 2'-O-methylcytidine-5'-phosphate
  modified_base (3)..(3): 2'-O-methyluridine-5'-phosphate
  modified_base (4)..(4): 2'-O-methylcytidine-5'-phosphate
  modified_base (6)..(6): 2'-O-methylcytidine-5'-phosphate
  modified_base (8)..(8): 2'-O-methyluridine-5'-phosphate
  modified_base (9)..(9): 2'-O-methylcytidine-5'-phosphate
  modified_base (10)..(11): 2'-O-methyluridine-5'-phosphate
  modified_base (13)..(13): 2'-O-methyluridine-5'-phosphate
  modified_base (15)..(15): 2'-O-methylcytidine-5'-phosphate
  modified_base (18)..(18): 2'-O-methyluridine-5'-phosphate
  modified_base (19)..(19): 2'-O-methylcytidine-5'-phosphate
  modified_base (21)..(21): 2'-deoxy-thymidine-5'-phosphate-phosphorothioate
gnnngnannnnananganntt

SEQ ID NO: 896 - DNA, 21 bp, Artificial Sequence
  Description of Artificial Sequence: Synthetic oligonucleotide
  modified_base (6)..(6): 2'-O-methyluridine-5'-phosphate
  modified_base (8)..(8): 2'-O-methyluridine-5'-phosphate
  modified_base (21)..(21): 2'-deoxy-thymidine-5'-phosphate-phosphorothioate
gaucgnanaagaugcgagctt

SEQ ID NO: 897 - DNA, 21 bp, Artificial Sequence
  Description of Artificial Sequence: Synthetic oligonucleotide
  modified_base (4)..(4): 2'-O-methyluridine-5'-phosphate
  modified_base (6)..(6): 2'-O-methyluridine-5'-phosphate
  modified_base (7)..(7): 2'-O-methylcytidine-5'-phosphate
  modified_base (9)..(10): 2'-O-methyluridine-5'-phosphate
  modified_base (15)..(15): 2'-O-methyluridine-5'-phosphate
  modified_base (16)..(16): 2'-O-methylcytidine-5'-phosphate
  modified_base (21)..(21): 2'-deoxy-thymidine-5'-phosphate-phosphorothioate
gagnannannggganngagtt

SEQ ID NO: 898 - DNA, 21 bp, Artificial Sequence
  Description of Artificial Sequence: Synthetic oligonucleotide
  modified_base (9)..(9): 2'-O-methylcytidine-5'-phosphate
  modified_base (15)..(15): 2'-O-methyluridine-5'-phosphate
  modified_base (21)..(21): 2'-deoxy-thymidine-5'-phosphate-phosphorothioate
cucgauccnaauganacuctt

SEQ ID NO: 899 - DNA, 21 bp, Artificial Sequence
  Description of Artificial Sequence: Synthetic oligonucleotide
  modified_base (1)..(1): 2'-O-methyluridine-5'-phosphate
  modified_base (2)..(2): 2'-O-methylcytidine-5'-phosphate
  modified_base (4)..(5): 2'-O-methyluridine-5'-phosphate
  modified_base (10)..(10): 2'-O-methyluridine-5'-phosphate
  modified_base (14)..(14): 2'-O-methyluridine-5'-phosphate
  modified_base (15)..(15): 2'-O-methylcytidine-5'-phosphate
  modified_base (18)..(18): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
nngnnagagngaannganntt

SEQ ID NO: 900 - DNA, 21 bp, Artificial Sequence
  Description of Artificial Sequence: Synthetic oligonucleotide
  modified_base (9)..(9): 2'-O-methylcytidine-5'-phosphate
  modified_base (14)..(14): 2'-O-methyluridine-5'-phosphate
  modified_base (21)..(21): 2'-deoxy-thymidine-5'-phosphate-phosphorothioate
agucgauunacucnaacgatt

SEQ ID NO: 901 - DNA, 21 bp, Artificial Sequence
  Description of Artificial Sequence: Synthetic oligonucleotide
  modified_base (5)..(5): 2'-O-methylcytidine-5'-phosphate
  modified_base (6)..(6): 2'-O-methyluridine-5'-phosphate
  modified_base (8)..(8): 2'-O-methylcytidine-5'-phosphate
  modified_base (12)..(12): 2'-O-methylcytidine-5'-phosphate
  modified_base (14)..(14): 2'-O-methyluridine-5'-phosphate
  modified_base (16)..(16): 2'-O-methyluridine-5'-phosphate
  modified_base (18)..(19): 2'-O-methylcytidine-5'-phosphate
  modified_base (21)..(21): 2'-deoxy-thymidine-5'-phosphate-phosphorothioate
ggagnngnggananananntt

SEQ ID NO: 902 - DNA, 21 bp, Artificial Sequence
  Description of Artificial Sequence: Synthetic oligonucleotide
  modified_base (3)..(3): 2'-O-methyluridine-5'-phosphate
  modified_base (5)..(5): 2'-O-methyluridine-5'-phosphate
  modified_base (13)..(13): 2'-O-methylcytidine-5'-phosphate
  modified_base (21)..(21): 2'-deoxy-thymidine-5'-phosphate-phosphorothioate
ggnanauguccgnagcucctt

SEQ ID NO: 903 - DNA, 21 bp, Artificial Sequence
  Description of Artificial Sequence: Synthetic oligonucleotide
  modified_base (5)..(6): 2'-O-methyluridine-5'-phosphate
  modified_base (9)..(10): 2'-O-methylcytidine-5'-phosphate
  modified_base (13)..(13): 2'-O-methylcytidine-5'-phosphate
  modified_base (14)..(14): 2'-O-methyluridine-5'-phosphate
  modified_base (17)..(17): 2'-O-methyluridine-5'-phosphate
  modified_base (18)..(18): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
gaganngannagnnagnnntn

SEQ ID NO: 904 - DNA, 21 bp, Artificial Sequence
  Description of Artificial Sequence: Synthetic oligonucleotide
  modified_base (5)..(5): 2'-O-methyluridine-5'-phosphate
  modified_base (13)..(13): 2'-O-methylcytidine-5'-phosphate
  modified_base (21)..(21): 2'-deoxy-thymidine-5'-phosphate-phosphorothioate
agacnagcuggunaaucuctt

SEQ ID NO: 905 - DNA, 21 bp, Artificial Sequence
  Description of Artificial Sequence: Synthetic oligonucleotide
  modified_base (1)..(2): 2'-O-methylcytidine-5'-phosphate
  modified_base (6)..(6): 2'-O-methylcytidine-5'-phosphate
  modified_base (12)..(12): 2'-O-methylcytidine-5'-phosphate
  modified_base (16)..(16): 2'-O-methyluridine-5'-phosphate
  modified_base (18)..(18): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
nnggangggagngaangnntt

SEQ ID NO: 906 - DNA, 21 bp, Artificial Sequence
  Description of Artificial Sequence: Synthetic oligonucleotide
  modified_base (3)..(3): 2'-O-methylcytidine-5'-phosphate
  modified_base (21)..(21): 2'-deoxy-thymidine-5'-phosphate-phosphorothioate
agnauucgcucccguccggtt

SEQ ID NO: 907 - DNA, 21 bp, Artificial Sequence
  Description of Artificial Sequence: Synthetic oligonucleotide
  modified_base (1)..(1): 2'-O-methylcytidine-5'-phosphate
  modified_base (7)..(7): 2'-O-methylcytidine-5'-phosphate
  modified_base (11)..(11): 2'-O-methyluridine-5'-phosphate
  modified_base (13)..(13): 2'-O-methylcytidine-5'-phosphate
  modified_base (14)..(15): 2'-O-methyluridine-5'-phosphate
  modified_base (17)..(19): 2'-O-methylcytidine-5'-phosphate
  modified_base (21)..(21): 2'-deoxy-thymidine-5'-phosphate-phosphorothioate
ngggagngaangnnnannntt

SEQ ID NO: 908 - DNA, 21 bp, Artificial Sequence
  Description of Artificial Sequence: Synthetic oligonucleotide
  modified_base (4)..(4): 2'-O-methyluridine-5'-phosphate
  modified_base (8)..(8): 2'-O-methylcytidine-5'-phosphate
  modified_base (21)..(21): 2'-deoxy-thymidine-5'-phosphate-phosphorothioate
gggnaagnauucgcucccgtt

SEQ ID NO: 909 - DNA, 21 bp, Artificial Sequence
  Description of Artificial Sequence: Synthetic oligonucleotide
  modified_base (1)..(1): 2'-O-methyluridine-5'-phosphate
  modified_base (4)..(6): 2'-O-methyluridine-5'-phosphate
  modified_base (10)..(10): 2'-O-methylcytidine-5'-phosphate
  modified_base (12)..(12): 2'-O-methylcytidine-5'-phosphate
  modified_base (13)..(13): 2'-O-methyluridine-5'-phosphate
  modified_base (17)..(17): 2'-O-methyluridine-5'-phosphate
  modified_base (19)..(19): 2'-O-methylcytidine-5'-phosphate
  modified_base (21)..(21): 2'-deoxy-thymidine-5'-phosphate-phosphorothioate
naannngganannagangntt

SEQ ID NO: 910 - DNA, 21 bp, Artificial Sequence
  Description of Artificial Sequence: Synthetic oligonucleotide
  modified_base (2)..(2): 2'-O-methylcytidine-5'-phosphate
  modified_base (6)..(6): 2'-O-methyluridine-5'-phosphate
  modified_base (13)..(13): 2'-O-methylcytidine-5'-phosphate
  modified_base (18)..(18): 2'-O-methyluridine-5'-phosphate
  modified_base (21)..(21): 2'-deoxy-thymidine-5'-phosphate-phosphorothioate
gnaucnagugucnaaaunatt

SEQ ID NO: 911 - DNA, 21 bp, Artificial Sequence
  Description of Artificial Sequence: Synthetic oligonucleotide
  modified_base (1)..(2): 2'-O-methyluridine-5'-phosphate
  modified_base (4)..(4): 2'-O-methyluridine-5'-phosphate
  modified_base (5)..(5): 2'-O-methylcytidine-5'-phosphate
  modified_base (7)..(7): 2'-O-methylcytidine-5'-phosphate
  modified_base (8)..(8): 2'-O-methyluridine-5'-phosphate
  modified_base (9)..(9): 2'-O-methylcytidine-5'-phosphate
  modified_base (12)..(12): 2'-O-methylcytidine-5'-phosphate
  modified_base (17)..(17): 2'-O-methylcytidine-5'-phosphate
  modified_base (21)..(21): 2'-deoxy-thymidine-5'-phosphate-phosphorothioate
nnanngnnnaangaganagtt

SEQ ID NO: 912 - DNA, 21 bp, Artificial Sequence
  Description of Artificial Sequence: Synthetic oligonucleotide
  modified_base (17)..(17): 2'-O-methyluridine-5'-phosphate
  modified_base (21)..(21): 2'-deoxy-thymidine-5'-phosphate-phosphorothioate
cugucucguugagcganaatt

SEQ ID NO: 913 - DNA, 21 bp, Artificial Sequence
  Description of Artificial Sequence: Synthetic oligonucleotide
  modified_base (7)..(7): 2'-O-methyluridine-5'-phosphate
  modified_base (8)..(8): 2'-O-methylcytidine-5'-phosphate
  modified_base (9)..(9): 2'-O-methyluridine-5'-phosphate
  modified_base (10)..(11): 2'-O-methylcytidine-5'-phosphate
  modified_base (14)..(15): 2'-O-methylcytidine-5'-phosphate
  modified_base (19)..(19): 2'-O-methylcytidine-5'-phosphate
  modified_base (21)..(21): 2'-deoxy-thymidine-5'-phosphate-phosphorothioate
gaagaannnnnganngggntt

SEQ ID NO: 914 - DNA, 21 bp, Artificial Sequence
  Description of Artificial Sequence: Synthetic oligonucleotide
  modified_base (14)..(14): 2'-O-methyluridine-5'-phosphate
  modified_base (17)..(17): 2'-O-methyluridine-5'-phosphate
  modified_base (21)..(21): 2'-deoxy-thymidine-5'-phosphate-phosphorothioate
gcccggucggaganucnuctt

SEQ ID NO: 915 - DNA, 21 bp, Artificial Sequence
  Description of Artificial Sequence: Synthetic oligonucleotide
  modified_base (5)..(5): 2'-O-methyluridine-5'-phosphate
  modified_base (6)..(6): 2'-O-methylcytidine-5'-phosphate
  modified_base (7)..(7): 2'-O-methyluridine-5'-phosphate
  modified_base (8)..(9): 2'-O-methylcytidine-5'-phosphate
  modified_base (12)..(13): 2'-O-methylcytidine-5'-phosphate
  modified_base (17)..(18): 2'-O-methylcytidine-5'-phosphate
  modified_base (21)..(21): 2'-deoxy-thymidine-5'-phosphate-phosphorothioate
agaannnnnganngggnnatt

SEQ ID NO: 916 - DNA, 21 bp, Artificial Sequence
  Description of Artificial Sequence: Synthetic oligonucleotide
  modified_base (21)..(21): 2'-deoxy-thymidine-5'-phosphate-phosphorothioate
uggcccggucggagauucutt

SEQ ID NO: 917 - DNA, 21 bp, Artificial Sequence
  Description of Artificial Sequence: Synthetic oligonucleotide
  modified_base (3)..(3): 2'-O-methylcytidine-5'-phosphate
  modified_base (6)..(6): 2'-O-methylcytidine-5'-phosphate
  modified_base (8)..(9): 2'-O-methyluridine-5'-phosphate
  modified_base (11)..(12): 2'-O-methylcytidine-5'-phosphate
  modified_base (14)..(14): 2'-O-methyluridine-5'-phosphate
  modified_base (15)..(15): 2'-O-methylcytidine-5'-phosphate
  modified_base (16)..(16): 2'-O-methyluridine-5'-phosphate
  modified_base (17)..(17): 2'-O-methylcytidine-5'-phosphate
  modified_base (21)..(21): 2'-deoxy-thymidine-5'-phosphate-phosphorothioate
aanaananngnngnnnnagtt

SEQ ID NO: 918 - DNA, 21 bp, Artificial Sequence
  Description of Artificial Sequence: Synthetic oligonucleotide
  modified_base (10)..(10): 2'-O-methylcytidine-5'-phosphate
  modified_base (21)..(21): 2'-deoxy-thymidine-5'-phosphate-phosphorothioate
cugagacggnaauguuguutt

SEQ ID NO: 919 - DNA, 21 bp, Artificial Sequence
  Description of Artificial Sequence: Synthetic oligonucleotide
  modified_base (2)..(2): 2'-O-methyluridine-5'-phosphate
  modified_base (3)..(3): 2'-O-methylcytidine-5'-phosphate
  modified_base (4)..(4): 2'-O-methyluridine-5'-phosphate
  modified_base (5)..(5): 2'-O-methylcytidine-5'-phosphate
  modified_base (10)..(11): 2'-O-methyluridine-5'-phosphate
  modified_base (12)..(12): 2'-O-methylcytidine-5'-phosphate
  modified_base (15)..(15): 2'-O-methylcytidine-5'-phosphate
  modified_base (21)..(21): 2'-deoxy-thymidine-5'-phosphate-phosphorothioate
gnnnnagaannnganagaatt

SEQ ID NO: 920 - DNA, 21 bp, Artificial Sequence
  Description of Artificial Sequence: Synthetic oligonucleotide
  modified_base (1)..(1): 2'-O-methyluridine-5'-phosphate
  modified_base (4)..(4): 2'-O-methyluridine-5'-phosphate
  modified_base (11)..(11): 2'-O-methyluridine-5'-phosphate
  modified_base (14)..(14): 2'-O-methyluridine-5'-phosphate
  modified_base (21)..(21): 2'-deoxy-thymidine-5'-phosphate-phosphorothioate
nucngucgaanucngagactt

SEQ ID NO: 921 - DNA, 21 bp, Artificial Sequence
  Description of Artificial Sequence: Synthetic oligonucleotide
  modified_base (1)..(1): 2'-O-methylcytidine-5'-phosphate
  modified_base (6)..(6): 2'-O-methylcytidine-5'-phosphate
  modified_base (7)..(7): 2'-O-methyluridine-5'-phosphate
  modified_base (9)..(9): 2'-O-methylcytidine-5'-phosphate
  modified_base (13)..(13): 2'-O-methylcytidine-5'-phosphate
  modified_base (15)..(15): 2'-O-methyluridine-5'-phosphate
  modified_base (17)..(17): 2'-O-methyluridine-5'-phosphate
  modified_base (19)..(19): 2'-O-methylcytidine-5'-phosphate
  modified_base (21)..(21): 2'-deoxy-thymidine-5'-phosphate-phosphorothioate
nggagnngngganananantt

SEQ ID NO: 922 - DNA, 21 bp, Artificial Sequence
  Description of Artificial Sequence: Synthetic oligonucleotide
  modified_base (2)..(2): 2'-O-methyluridine-5'-phosphate
  modified_base (4)..(4): 2'-O-methyluridine-5'-phosphate
  modified_base (12)..(12): 2'-O-methylcytidine-5'-phosphate
  modified_base (21)..(21): 2'-deoxy-thymidine-5'-phosphate-phosphorothioate
gnanauguccgnagcuccgtt

SEQ ID NO: 923 - DNA, 21 bp, Artificial Sequence
  Description of Artificial Sequence: Synthetic oligonucleotide
  modified_base (4)..(5): 2'-O-methyluridine-5'-phosphate
  modified_base (8)..(9): 2'-O-methylcytidine-5'-phosphate
  modified_base (12)..(12): 2'-O-methylcytidine-5'-phosphate
  modified_base (13)..(13): 2'-O-methyluridine-5'-phosphate
  modified_base (16)..(16): 2'-O-methyluridine-5'-phosphate
  modified_base (17)..(17): 2'-O-methylcytidine-5'-phosphate
  modified_base (18)..(18): 2'-O-methyluridine-5'-phosphate
  modified_base (21)..(21): 2'-deoxy-thymidine-5'-phosphate-phosphorothioate
aganngannagnnagnnngtt

SEQ ID NO: 924 - DNA, 21 bp, Artificial Sequence
  Description of Artificial Sequence: Synthetic oligonucleotide
  modified_base (1)..(1): 2'-O-methylcytidine-5'-phosphate
  modified_base (6)..(6): 2'-O-methyluridine-5'-phosphate
  modified_base (14)..(14): 2'-O-methylcytidine-5'-phosphate
  modified_base (21)..(21): 2'-deoxy-thymidine-5'-phosphate-phosphorothioate
nagacnagcuggunaaucutt

SEQ ID NO: 925 - DNA, 21 bp, Artificial Sequence
  Description of Artificial Sequence: Synthetic oligonucleotide
  modified_base (1)..(2): 2'-O-methyluridine-5'-phosphate
  modified_base (3)..(3): 2'-O-methylcytidine-5'-phosphate
  modified_base (6)..(6): 2'-O-methylcytidine-5'-phosphate
  modified_base (13)..(13): 2'-O-methyluridine-5'-phosphate
  modified_base (14)..(14): 2'-O-methylcytidine-5'-phosphate
  modified_base (21)..(21): 2'-deoxy-thymidine-5'-phosphate-phosphorothioate
nnnganagaaggnngaagatt

SEQ ID NO: 926 - DNA, 21 bp, Artificial Sequence
  Description of Artificial Sequence: Synthetic oligonucleotide
  modified_base (21)..(21): 2'-deoxy-thymidine-5'-phosphate-phosphorothioate
ucuucgaccuucugucgaatt

SEQ ID NO: 927 - DNA, 21 bp, Artificial Sequence
  Description of Artificial Sequence: Synthetic oligonucleotide
  modified_base (4)..(4): 2'-O-methyluridine-5'-phosphate
  modified_base (5)..(7): 2'-O-methylcytidine-5'-phosphate
  modified_base (9)..(9): 2'-O-methyluridine-5'-phosphate
  modified_base (11)..(11): 2'-O-methylcytidine-5'-phosphate
  modified_base (12)..(14): 2'-O-methyluridine-5'-phosphate
  modified_base (18)..(19): 2'-O-methylcytidine-5'-phosphate
  modified_base (21)..(21): 2'-deoxy-thymidine-5'-phosphate-phosphorothioate
ggannnngnannnngganntt

SEQ ID NO: 928 - DNA, 21 bp, Artificial Sequence
  Description of Artificial Sequence: Synthetic oligonucleotide
  modified_base (5)..(5): 2'-O-methylcytidine-5'-phosphate
  modified_base (10)..(10): 2'-O-methyluridine-5'-phosphate
  modified_base (21)..(21): 2'-deoxy-thymidine-5'-phosphate-phosphorothioate
ggucnaaagnacgggaucctt

SEQ ID NO: 929 - DNA, 21 bp, Artificial Sequence
  Description of Artificial Sequence: Synthetic oligonucleotide
  modified_base (1)..(1): 2'-O-methylcytidine-5'-phosphate
  modified_base (2)..(3): 2'-O-methyluridine-5'-phosphate
  modified_base (6)..(7): 2'-O-methylcytidine-5'-phosphate
  modified_base (8)..(8): 2'-O-methyluridine-5'-phosphate
  modified_base (10)..(10): 2'-O-methylcytidine-5'-phosphate
  modified_base (11)..(11): 2'-O-methyluridine-5'-phosphate
  modified_base (12)..(13): 2'-O-methylcytidine-5'-phosphate
  modified_base (16)..(17): 2'-O-methyluridine-5'-phosphate
  modified_base (19)..(19): 2'-O-methylcytidine-5'-phosphate
  modified_base (21)..(21): 2'-deoxy-thymidine-5'-phosphate-phosphorothioate
nnnagnnnannnnaanngntt

SEQ ID NO: 930 - DNA, 21 bp, Artificial Sequence
  Description of Artificial Sequence: Synthetic oligonucleotide
  modified_base (2)..(2): 2'-O-methylcytidine-5'-phosphate
  modified_base (11)..(11): 2'-O-methyluridine-5'-phosphate
  modified_base (16)..(16): 2'-O-methyluridine-5'-phosphate
  modified_base (21)..(21): 2'-deoxy-thymidine-5'-phosphate-phosphorothioate
gnaauuggagnaggcnaagtt

SEQ ID NO: 931 - DNA, 21 bp, Artificial Sequence
  Description of Artificial Sequence: Synthetic oligonucleotide
  modified_base (3)..(3): 2'-O-methylcytidine-5'-phosphate
  modified_base (4)..(4): 2'-O-methyluridine-5'-phosphate
  modified_base (7)..(7): 2'-O-methyluridine-5'-phosphate
  modified_base (8)..(8): 2'-O-methylcytidine-5'-phosphate
  modified_base (9)..(9): 2'-O-methyluridine-5'-phosphate
  modified_base (11)..(11): 2'-O-methylcytidine-5'-phosphate
  modified_base (17)..(17): 2'-O-methyluridine-5'-phosphate
  modified_base (18)..(18): 2'-O-methylcytidine-5'-phosphate
  modified_base (21)..(21): 2'-deoxy-thymidine-5'-phosphate-phosphorothioate
agnnagnnngnaaggannatt

SEQ ID NO: 932 - DNA, 21 bp, Artificial Sequence
  Description of Artificial Sequence: Synthetic oligonucleotide
  modified_base (10)..(10): 2'-O-methylcytidine-5'-phosphate
  modified_base (15)..(15): 2'-O-methyluridine-5'-phosphate
  modified_base (21)..(21): 2'-deoxy-thymidine-5'-phosphate-phosphorothioate
ugauccuugnagacnagcutt

SEQ ID NO: 933 - DNA, 21 bp, Artificial Sequence
  Description of Artificial Sequence: Synthetic oligonucleotide
  modified_base (3)..(3): 2'-O-methylcytidine-5'-phosphate
  modified_base (8)..(8): 2'-O-methyluridine-5'-phosphate
  modified_base (10)..(10): 2'-O-methyluridine-5'-phosphate
  modified_base (11)..(11): 2'-O-methylcytidine-5'-phosphate
  modified_base (12)..(12): 2'-O-methyluridine-5'-phosphate
  modified_base (14)..(14): 2'-O-methylcytidine-5'-phosphate
  modified_base (15)..(15): 2'-O-methyluridine-5'-phosphate
  modified_base (18)..(18): 2'-O-methyluridine-5'-phosphate
  modified_base (21)..(21): 2'-deoxy-thymidine-5'-phosphate-phosphorothioate
agnggagnannnannganatt

SEQ ID NO: 934 - DNA, 21 bp, Artificial Sequence
  Description of Artificial Sequence: Synthetic oligonucleotide
  modified_base (1)..(1): 2'-O-methyluridine-5'-phosphate
  modified_base (4)..(4): 2'-O-methylcytidine-5'-phosphate
  modified_base (7)..(7): 2'-O-methyluridine-5'-phosphate
  modified_base (11)..(11): 2'-O-methyluridine-5'-phosphate
  modified_base (21)..(21): 2'-deoxy-thymidine-5'-phosphate-phosphorothioate
naunagnaganacuccgcutt

SEQ ID NO: 935 - DNA, 21 bp, Artificial Sequence
  Description of Artificial Sequence: Synthetic oligonucleotide
  modified_base (3)..(3): 2'-O-methylcytidine-5'-phosphate
  modified_base (9)..(9): 2'-O-methylcytidine-5'-phosphate
  modified_base (13)..(13): 2'-O-methyluridine-5'-phosphate
  modified_base (15)..(15): 2'-O-methylcytidine-5'-phosphate
  modified_base (16)..(17): 2'-O-methyluridine-5'-phosphate
  modified_base (19)..(19): 2'-O-methylcytidine-5'-phosphate
  modified_base (21)..(21): 2'-deoxy-thymidine-5'-phosphate-phosphorothioate
gangggagngaangnnnantt

SEQ ID NO: 936 - DNA, 21 bp, Artificial Sequence
  Description of Artificial Sequence: Synthetic oligonucleotide
  modified_base (2)..(2): 2'-O-methyluridine-5'-phosphate
  modified_base (6)..(6): 2'-O-methylcytidine-5'-phosphate
  modified_base (21)..(21): 2'-deoxy-thymidine-5'-phosphate-phosphorothioate
gnaagnauucgcucccguctt

SEQ ID NO: 937 - DNA, 21 bp, Artificial Sequence
  Description of Artificial Sequence: Synthetic oligonucleotide
  modified_base (3)..(4): 2'-O-methyluridine-5'-phosphate
  modified_base (5)..(5): 2'-O-methylcytidine-5'-phosphate
  modified_base (8)..(8): 2'-O-methylcytidine-5'-phosphate
  modified_base (15)..(15): 2'-O-methyluridine-5'-phosphate
  modified_base (16)..(16): 2'-O-methylcytidine-5'-phosphate
  modified_base (21)..(21): 2'-deoxy-thymidine-5'-phosphate-phosphorothioate
aannnganagaaggnngaatt

SEQ ID NO: 938 - DNA, 21 bp, Artificial Sequence
  Description of Artificial Sequence: Synthetic oligonucleotide
  modified_base (1)..(1): 2'-O-methyluridine-5'-phosphate
  modified_base (8)..(8): 2'-O-methyluridine-5'-phosphate
  modified_base (11)..(11): 2'-O-methyluridine-5'-phosphate
  modified_base (21)..(21): 2'-deoxy-thymidine-5'-phosphate-phosphorothioate
nucgaccnucngucgaauutt

SEQ ID NO: 939 - DNA, 21 bp, Artificial Sequence
  Description of Artificial Sequence: Synthetic oligonucleotide
  modified_base (1)..(1): 2'-O-methyluridine-5'-phosphate
  modified_base (2)..(2): 2'-O-methylcytidine-5'-phosphate
  modified_base (5)..(5): 2'-O-methylcytidine-5'-phosphate
  modified_base (12)..(12): 2'-O-methyluridine-5'-phosphate
  modified_base (13)..(13): 2'-O-methylcytidine-5'-phosphate
  modified_base (21)..(21): 2'-deoxy-thymidine-5'-phosphate-phosphorothioate
nnganagaaggnngaagagtt

SEQ ID NO: 940 - DNA, 21 bp, Artificial Sequence
  Description of Artificial Sequence: Synthetic oligonucleotide
  modified_base (4)..(4): 2'-O-methyluridine-5'-phosphate
  modified_base (11)..(11): 2'-O-methyluridine-5'-phosphate
  modified_base (14)..(14): 2'-O-methyluridine-5'-phosphate
  modified_base (21)..(21): 2'-deoxy-thymidine-5'-phosphate-phosphorothioate
cucnucgaccnucngucgatt

SEQ ID NO: 941 - DNA, 21 bp, Artificial Sequence
  Description of Artificial Sequence: Synthetic oligonucleotide
  modified_base (1)..(1): 2'-O-methyluridine-5'-phosphate
  modified_base (3)..(3): 2'-O-methylcytidine-5'-phosphate
  modified_base (7)..(7): 2'-O-methylcytidine-5'-phosphate
  modified_base (9)..(9): 2'-O-methyluridine-5'-phosphate
  modified_base (11)..(11): 2'-O-methyluridine-5'-phosphate
  modified_base (13)..(14): 2'-O-methylcytidine-5'-phosphate
  modified_base (16)..(16): 2'-O-methyluridine-5'-phosphate
  modified_base (18)..(18): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
ngngganananannananntt

SEQ ID NO: 942 - DNA, 21 bp, Artificial Sequence
  Description of Artificial Sequence: Synthetic oligonucleotide
  modified_base (3)..(3): 2'-O-methyluridine-5'-phosphate
  modified_base (8)..(8): 2'-O-methyluridine-5'-phosphate
  modified_base (10)..(10): 2'-O-methyluridine-5'-phosphate
  modified_base (18)..(18): 2'-O-methylcytidine-5'-phosphate
  modified_base (21)..(21): 2'-deoxy-thymidine-5'-phosphate-phosphorothioate
agnauggnanauguccgnatt

SEQ ID NO: 943 - DNA, 21 bp, Artificial Sequence
  Description of Artificial Sequence: Synthetic oligonucleotide
  modified_base (1)..(1): 2'-O-methyluridine-5'-phosphate
  modified_base (2)..(2): 2'-O-methylcytidine-5'-phosphate
  modified_base (3)..(4): 2'-O-methyluridine-5'-phosphate
  modified_base (7)..(8): 2'-O-methylcytidine-5'-phosphate
  modified_base (9)..(9): 2'-O-methyluridine-5'-phosphate
  modified_base (11)..(11): 2'-O-methylcytidine-5'-phosphate
  modified_base (12)..(12): 2'-O-methyluridine-5'-phosphate
  modified_base (13)..(14): 2'-O-methylcytidine-5'-phosphate
  modified_base (17)..(18): 2'-O-methyluridine-5'-phosphate
  modified_base (21)..(21): 2'-deoxy-thymidine-5'-phosphate-phosphorothioate
nnnnagnnnannnnaanngtt

SEQ ID NO: 944 - DNA, 21 bp, Artificial Sequence
  Description of Artificial Sequence: Synthetic oligonucleotide
  modified_base (1)..(1): 2'-O-methylcytidine-5'-phosphate
  modified_base (10)..(10): 2'-O-methyluridine-5'-phosphate
  modified_base (15)..(15): 2'-O-methyluridine-5'-phosphate
  modified_base (21)..(21): 2'-deoxy-thymidine-5'-phosphate-phosphorothioate
naauuggagnaggcnaagatt

SEQ ID NO: 945 - DNA, 21 bp, Artificial Sequence
  Description of Artificial Sequence: Synthetic oligonucleotide
  modified_base (1)..(3): 2'-O-methyluridine-5'-phosphate
  modified_base (5)..(5): 2'-O-methyluridine-5'-phosphate
  modified_base (6)..(6): 2'-O-methylcytidine-5'-phosphate
  modified_base (8)..(8): 2'-O-methylcytidine-5'-phosphate
  modified_base (9)..(9): 2'-O-methyluridine-5'-phosphate
  modified_base (10)..(10): 2'-O-methylcytidine-5'-phosphate
  modified_base (13)..(13): 2'-O-methylcytidine-5'-phosphate
  modified_base (18)..(18): 2'-O-methylcytidine-5'-phosphate
  modified_base (21)..(21): 2'-deoxy-thymidine-5'-phosphate-phosphorothioate
nnnanngnnnaangaganatt

SEQ ID NO: 946 - DNA, 21 bp, Artificial Sequence
  Description of Artificial Sequence: Synthetic oligonucleotide
  modified_base (16)..(16): 2'-O-methyluridine-5'-phosphate
  modified_base (21)..(21): 2'-deoxy-thymidine-5'-phosphate-phosphorothioate
ugucucguugagcganaaatt

SEQ ID NO: 947 - DNA, 21 bp, Artificial Sequence
  Description of Artificial Sequence: Synthetic oligonucleotide
  modified_base (2)..(2): 2'-O-methylcytidine-5'-phosphate
  modified_base (3)..(3): 2'-O-methyluridine-5'-phosphate
  modified_base (6)..(6): 2'-O-methyluridine-5'-phosphate
  modified_base (7)..(7): 2'-O-methylcytidine-5'-phosphate
  modified_base (8)..(8): 2'-O-methyluridine-5'-phosphate
  modified_base (10)..(10): 2'-O-methylcytidine-5'-phosphate
  modified_base (16)..(16): 2'-O-methyluridine-5'-phosphate
  modified_base (17)..(17): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
gnnagnnngnaaggannantt

SEQ ID NO: 948 - DNA, 21 bp, Artificial Sequence
  Description of Artificial Sequence: Synthetic oligonucleotide
  modified_base (11)..(11): 2'-O-methylcytidine-5'-phosphate
  modified_base (16)..(16): 2'-O-methyluridine-5'-phosphate
  modified_base (21)..(21): 2'-deoxy-thymidine-5'-phosphate-phosphorothioate
augauccuugnagacnagctt

SEQ ID NO: 949 - DNA, 21 bp, Artificial Sequence
  Description of Artificial Sequence: Synthetic oligonucleotide
  modified_base (1)..(1): 2'-O-methyluridine-5'-phosphate
  modified_base (6)..(6): 2'-O-methyluridine-5'-phosphate
  modified_base (7)..(9): 2'-O-methylcytidine-5'-phosphate
  modified_base (10)..(10): 2'-O-methyluridine-5'-phosphate
  modified_base (12)..(12): 2'-O-methylcytidine-5'-phosphate
  modified_base (15)..(18): 2'-O-methyluridine-5'-phosphate
  modified_base (19)..(19): 2'-O-methylcytidine-5'-phosphate
  modified_base (21)..(21): 2'-deoxy-thymidine-5'-phosphate-phosphorothioate
nagagnnnnnanggnnnnntt

SEQ ID NO: 950 - DNA, 21 bp, Artificial Sequence
  Description of Artificial Sequence: Synthetic oligonucleotide
  modified_base (9)..(9): 2'-O-methyluridine-5'-phosphate
  modified_base (18)..(18): 2'-O-methyluridine-5'-phosphate
  modified_base (21)..(21): 2'-deoxy-thymidine-5'-phosphate-phosphorothioate
gaaaaccgnagggacucnatt

SEQ ID NO: 951 - DNA, 21 bp, Artificial Sequence
  Description of Artificial Sequence: Synthetic oligonucleotide
  modified_base (1)..(1): 2'-O-methylcytidine-5'-phosphate
  modified_base (4)..(4): 2'-O-methylcytidine-5'-phosphate
  modified_base (8)..(8): 2'-O-methylcytidine-5'-phosphate
  modified_base (9)..(9): 2'-O-methyluridine-5'-phosphate
  modified_base (11)..(12): 2'-O-methylcytidine-5'-phosphate
  modified_base (14)..(14): 2'-O-methyluridine-5'-phosphate
  modified_base (17)..(17): 2'-O-methyluridine-5'-phosphate
  modified_base (21)..(21): 2'-deoxy-thymidine-5'-phosphate-phosphorothioate
naanagannanngnagnagtt

SEQ ID NO: 952 - DNA, 21 bp, Artificial Sequence
  Description of Artificial Sequence: Synthetic oligonucleotide
  modified_base (2)..(2): 2'-O-methyluridine-5'-phosphate
  modified_base (5)..(5): 2'-O-methyluridine-5'-phosphate
  modified_base (10)..(10): 2'-O-methyluridine-5'-phosphate
  modified_base (21)..(21): 2'-deoxy-thymidine-5'-phosphate-phosphorothioate
cnacnacggnagucuguugtt

SEQ ID NO: 953 - DNA, 21 bp, Artificial Sequence
  Description of Artificial Sequence: Synthetic oligonucleotide
  modified_base (4)..(5): 2'-O-methylcytidine-5'-phosphate
  modified_base (6)..(6): 2'-O-methyluridine-5'-phosphate
  modified_base (8)..(8): 2'-O-methylcytidine-5'-phosphate
  modified_base (10)..(10): 2'-O-methylcytidine-5'-phosphate
  modified_base (11)..(12): 2'-O-methyluridine-5'-phosphate
  modified_base (14)..(14): 2'-O-methylcytidine-5'-phosphate
  modified_base (15)..(16): 2'-O-methyluridine-5'-phosphate
  modified_base (18)..(19): 2'-O-methylcytidine-5'-phosphate
  modified_base (21)..(21): 2'-deoxy-thymidine-5'-phosphate-phosphorothioate
aggnnnangnnnannngnntt

SEQ ID NO: 954 - DNA, 21 bp, Artificial Sequence
  Description of Artificial Sequence: Synthetic oligonucleotide
  modified_base (3)..(3): 2'-O-methylcytidine-5'-phosphate
  modified_base (7)..(7): 2'-O-methyluridine-5'-phosphate
  modified_base (13)..(13): 2'-O-methyluridine-5'-phosphate
  modified_base (21)..(21): 2'-deoxy-thymidine-5'-phosphate-phosphorothioate
ggnaagnaagcgnaggccutt

SEQ ID NO: 955 - DNA, 21 bp, Artificial Sequence
  Description of Artificial Sequence: Synthetic oligonucleotide
  modified_base (6)..(7): 2'-O-methyluridine-5'-phosphate
  modified_base (8)..(8): 2'-O-methylcytidine-5'-phosphate
  modified_base (10)..(10): 2'-O-methylcytidine-5'-phosphate
  modified_base (12)..(12): 2'-O-methyluridine-5'-phosphate
  modified_base (14)..(15): 2'-O-methylcytidine-5'-phosphate
  modified_base (18)..(19): 2'-O-methylcytidine-5'-phosphate
  modified_base (21)..(21): 2'-deoxy-thymidine-5'-phosphate-phosphorothioate
aggaannnangngnnganntt

SEQ ID NO: 956 - DNA, 21 bp, Artificial Sequence
  Description of Artificial Sequence: Synthetic oligonucleotide
  modified_base (7)..(7): 2'-O-methylcytidine-5'-phosphate
  modified_base (21)..(21): 2'-deoxy-thymidine-5'-phosphate-phosphorothioate
ggucggnacgugaauuccutt

SEQ ID NO: 957 - DNA, 21 bp, Artificial Sequence
  Description of Artificial Sequence: Synthetic oligonucleotide
  modified_base (1)..(1): 2'-O-methylcytidine-5'-phosphate
  modified_base (2)..(3): 2'-O-methyluridine-5'-phosphate
  modified_base (9)..(10): 2'-O-methylcytidine-5'-phosphate
  modified_base (11)..(11): 2'-O-methyluridine-5'-phosphate
  modified_base (14)..(15): 2'-O-methylcytidine-5'-phosphate
  modified_base (18)..(19): 2'-O-methylcytidine-5'-phosphate
  modified_base (21)..(21): 2'-deoxy-thymidine-5'-phosphate-phosphorothioate
nnngaaagnnnaannganntt

SEQ ID NO: 958 - DNA, 21 bp, Artificial Sequence
  Description of Artificial Sequence: Synthetic oligonucleotide
  modified_base (8)..(8): 2'-O-methyluridine-5'-phosphate
  modified_base (16)..(16): 2'-O-methylcytidine-5'-phosphate
  modified_base (21)..(21): 2'-deoxy-thymidine-5'-phosphate-phosphorothioate
ggucggunaggcuuunaagtt

SEQ ID NO: 959 - DNA, 21 bp, Artificial Sequence
  Description of Artificial Sequence: Synthetic oligonucleotide
  modified_base (3)..(3): 2'-O-methylcytidine-5'-phosphate
  modified_base (6)..(6): 2'-O-methylcytidine-5'-phosphate
  modified_base (10)..(10): 2'-O-methylcytidine-5'-phosphate
  modified_base (11)..(11): 2'-O-methyluridine-5'-phosphate
  modified_base (13)..(14): 2'-O-methylcytidine-5'-phosphate
  modified_base (16)..(16): 2'-O-methyluridine-5'-phosphate
  modified_base (19)..(19): 2'-O-methyluridine-5'-phosphate
  modified_base (21)..(21): 2'-deoxy-thymidine-5'-phosphate-phosphorothioate
aanaanagannanngnagntt

SEQ ID NO: 960 - DNA, 21 bp, Artificial Sequence
  Description of Artificial Sequence: Synthetic oligonucleotide
  modified_base (3)..(3): 2'-O-methyluridine-5'-phosphate
  modified_base (8)..(8): 2'-O-methyluridine-5'-phosphate
  modified_base (21)..(21): 2'-deoxy-thymidine-5'-phosphate-phosphorothioate
acnacggnagucuguuguutt

SEQ ID NO: 961 - DNA, 21 bp, Artificial Sequence
  Description of Artificial Sequence: Synthetic oligonucleotide
  modified_base (2)..(2): 2'-O-methylcytidine-5'-phosphate
  modified_base (5)..(5): 2'-O-methylcytidine-5'-phosphate
  modified_base (9)..(9): 2'-O-methylcytidine-5'-phosphate
  modified_base (10)..(10): 2'-O-methyluridine-5'-phosphate
  modified_base (12)..(13): 2'-O-methylcytidine-5'-phosphate
  modified_base (15)..(15): 2'-O-methyluridine-5'-phosphate
  modified_base (18)..(18): 2'-O-methyluridine-5'-phosphate
  modified_base (21)..(21): 2'-deoxy-thymidine-5'-phosphate-phosphorothioate
anaanagannanngnagnatt

SEQ ID NO: 962 - DNA, 21 bp, Artificial Sequence
  Description of Artificial Sequence: Synthetic oligonucleotide
  modified_base (1)..(1): 2'-O-methyluridine-5'-phosphate
  modified_base (4)..(4): 2'-O-methyluridine-5'-phosphate
  modified_base (9)..(9): 2'-O-methyluridine-5'-phosphate
  modified_base (21)..(21): 2'-deoxy-thymidine-5'-phosphate-phosphorothioate
nacnacggnagucuguugutt

SEQ ID NO: 963 - DNA, 21 bp, Artificial Sequence
  Description of Artificial Sequence: Synthetic oligonucleotide
  modified_base (1)..(2): 2'-O-methylcytidine-5'-phosphate
  modified_base (3)..(3): 2'-O-methyluridine-5'-phosphate
  modified_base (5)..(5): 2'-O-methylcytidine-5'-phosphate
  modified_base (6)..(7): 2'-O-methyluridine-5'-phosphate
  modified_base (8)..(8): 2'-O-methylcytidine-5'-phosphate
  modified_base (9)..(10): 2'-O-methyluridine-5'-phosphate
  modified_base (12)..(12): 2'-O-methyluridine-5'-phosphate
  modified_base (15)..(15): 2'-O-methylcytidine-5'-phosphate
  modified_base (17)..(17): 2'-O-methylcytidine-5'-phosphate
  modified_base (21)..(21): 2'-deoxy-thymidine-5'-phosphate-phosphorothioate
nnnannnnnnanagnanggtt

SEQ ID NO: 964 - DNA, 21 bp, Artificial Sequence
  Description of Artificial Sequence: Synthetic oligonucleotide
  modified_base (7)..(7): 2'-O-methyluridine-5'-phosphate
  modified_base (9)..(9): 2'-O-methyluridine-5'-phosphate
  modified_base (16)..(16): 2'-O-methyluridine-5'-phosphate
  modified_base (21)..(21): 2'-deoxy-thymidine-5'-phosphate-phosphorothioate
ccgugcnanaagaagnaggtt

SEQ ID NO: 965 - DNA, 21 bp, Artificial Sequence
  Description of Artificial Sequence: Synthetic oligonucleotide
  modified_base (3)..(3): 2'-O-methylcytidine-5'-phosphate
  modified_base (8)..(8): 2'-O-methyluridine-5'-phosphate
  modified_base (9)..(10): 2'-O-methylcytidine-5'-phosphate
  modified_base (12)..(14): 2'-O-methyluridine-5'-phosphate
  modified_base (15)..(17): 2'-O-methylcytidine-5'-phosphate
  modified_base (21)..(21): 2'-deoxy-thymidine-5'-phosphate-phosphorothioate
ganaagannnannnnnnggtt

SEQ ID NO: 966 - DNA, 21 bp, Artificial Sequence
  Description of Artificial Sequence: Synthetic oligonucleotide
  modified_base (9)..(9): 2'-O-methyluridine-5'-phosphate
  modified_base (15)..(16): 2'-O-methyluridine-5'-phosphate
  modified_base (21)..(21): 2'-deoxy-thymidine-5'-phosphate-phosphorothioate
ccgggaaanggaucnnguctt

SEQ ID NO: 967 - DNA, 21 bp, Artificial Sequence
  Description of Artificial Sequence: Synthetic oligonucleotide
  modified_base (1)..(1): 2'-O-methyluridine-5'-phosphate
  modified_base (2)..(2): 2'-O-methylcytidine-5'-phosphate
  modified_base (4)..(4): 2'-O-methyluridine-5'-phosphate
  modified_base (8)..(8): 2'-O-methylcytidine-5'-phosphate
  modified_base (10)..(10): 2'-O-methylcytidine-5'-phosphate
  modified_base (17)..(17): 2'-O-methyluridine-5'-phosphate
  modified_base (18)..(18): 2'-O-methylcytidine-5'-phosphate
  modified_base (21)..(21): 2'-deoxy-thymidine-5'-phosphate-phosphorothioate
nngngagngngggagannatt

SEQ ID NO: 968 - DNA, 21 bp, Artificial Sequence
  Description of Artificial Sequence: Synthetic oligonucleotide
  modified_base (15)..(15): 2'-O-methylcytidine-5'-phosphate
  modified_base (21)..(21): 2'-deoxy-thymidine-5'-phosphate-phosphorothioate
ugaucucccgcgcunacgatt

SEQ ID NO: 969 - DNA, 21 bp, Artificial Sequence
  Description of Artificial Sequence: Synthetic oligonucleotide
  modified_base (3)..(4): 2'-O-methyluridine-5'-phosphate
  modified_base (5)..(5): 2'-O-methylcytidine-5'-phosphate
  modified_base (7)..(7): 2'-O-methylcytidine-5'-phosphate
  modified_base (9)..(9): 2'-O-methyluridine-5'-phosphate
  modified_base (11)..(12): 2'-O-methylcytidine-5'-phosphate
  modified_base (15)..(16): 2'-O-methylcytidine-5'-phosphate
  modified_base (19)..(19): 2'-O-methylcytidine-5'-phosphate
  modified_base (21)..(21): 2'-deoxy-thymidine-5'-phosphate-phosphorothioate
aannnangngnngannagntt

SEQ ID NO: 970 - DNA, 21 bp, Artificial Sequence
  Description of Artificial Sequence: Synthetic oligonucleotide
  modified_base (10)..(10): 2'-O-methylcytidine-5'-phosphate
  modified_base (21)..(21): 2'-deoxy-thymidine-5'-phosphate-phosphorothioate
gcuggucggnacgugaauutt

SEQ ID NO: 971 - DNA, 21 bp, Artificial Sequence
  Description of Artificial Sequence: Synthetic oligonucleotide
  modified_base (1)..(1): 2'-O-methyluridine-5'-phosphate
  modified_base (4)..(4): 2'-O-methyluridine-5'-phosphate
  modified_base (5)..(5): 2'-O-methylcytidine-5'-phosphate
  modified_base (10)..(10): 2'-O-methyluridine-5'-phosphate
  modified_base (12)..(12): 2'-O-methylcytidine-5'-phosphate
  modified_base (13)..(14): 2'-O-methyluridine-5'-phosphate
  modified_base (15)..(15): 2'-O-methylcytidine-5'-phosphate
  modified_base (17)..(17): 2'-O-methylcytidine-5'-phosphate
  modified_base (21)..(21): 2'-deoxy-thymidine-5'-phosphate-phosphorothioate
nagnngaagnannnngnaatt

SEQ ID NO: 972 - DNA, 21 bp, Artificial Sequence
  Description of Artificial Sequence: Synthetic oligonucleotide
  modified_base (9)..(9): 2'-O-methyluridine-5'-phosphate
  modified_base (18)..(18): 2'-O-methyluridine-5'-phosphate
  modified_base (21)..(21): 2'-deoxy-thymidine-5'-phosphate-phosphorothioate
uugcgaagnacuucgacnatt

SEQ ID NO: 973 - DNA, 21 bp, Artificial Sequence
  Description of Artificial Sequence: Synthetic oligonucleotide
  modified_base (1)..(1): 2'-O-methyluridine-5'-phosphate
  modified_base (2)..(4): 2'-O-methylcytidine-5'-phosphate
  modified_base (5)..(5): 2'-O-methyluridine-5'-phosphate
  modified_base (11)..(11): 2'-O-methylcytidine-5'-phosphate
  modified_base (13)..(14): 2'-O-methyluridine-5'-phosphate
  modified_base (18)..(18): 2'-O-methyluridine-5'-phosphate
  modified_base (19)..(19): 2'-O-methylcytidine-5'-phosphate
  modified_base (21)..(21): 2'-deoxy-thymidine-5'-phosphate-phosphorothioate
nnnnnagaagngnngaanntt

SEQ ID NO: 974 - DNA, 21 bp, Artificial Sequence
  Description of Artificial Sequence: Synthetic oligonucleotide
  modified_base (5)..(5): 2'-O-methylcytidine-5'-phosphate
  modified_base (14)..(14): 2'-O-methyluridine-5'-phosphate
  modified_base (21)..(21): 2'-deoxy-thymidine-5'-phosphate-phosphorothioate
gauunaacgcuucnagggatt

SEQ ID NO: 975 - DNA, 21 bp, Artificial Sequence
  Description of Artificial Sequence: Synthetic oligonucleotide
  modified_base (1)..(1): 2'-O-methyluridine-5'-phosphate
  modified_base (3)..(3): 2'-O-methyluridine-5'-phosphate
  modified_base (7)..(8): 2'-O-methyluridine-5'-phosphate
  modified_base (10)..(10): 2'-O-methyluridine-5'-phosphate
  modified_base (11)..(11): 2'-O-methylcytidine-5'-phosphate
  modified_base (12)..(13): 2'-O-methyluridine-5'-phosphate
  modified_base (15)..(15): 2'-O-methyluridine-5'-phosphate
  modified_base (16)..(16): 2'-O-methylcytidine-5'-phosphate
  modified_base (21)..(21): 2'-deoxy-thymidine-5'-phosphate-phosphorothioate
nangggnnannnngnngagtt

SEQ ID NO: 976 - DNA, 21 bp, Artificial Sequence
  Description of Artificial Sequence: Synthetic oligonucleotide
  modified_base (6)..(6): 2'-O-methylcytidine-5'-phosphate
  modified_base (11)..(11): 2'-O-methyluridine-5'-phosphate
  modified_base (16)..(16): 2'-O-methylcytidine-5'-phosphate
  modified_base (18)..(18): 2'-O-methyluridine-5'-phosphate
  modified_base (21)..(21): 2'-deoxy-thymidine-5'-phosphate-phosphorothioate
cucganaaganaaccnanatt

SEQ ID NO: 977 - DNA, 21 bp, Artificial Sequence
  Description of Artificial Sequence: Synthetic oligonucleotide
  modified_base (3)..(3): 2'-O-methylcytidine-5'-phosphate
  modified_base (5)..(5): 2'-O-methyluridine-5'-phosphate
  modified_base (11)..(11): 2'-O-methylcytidine-5'-phosphate
  modified_base (12)..(12): 2'-O-methyluridine-5'-phosphate
  modified_base (13)..(13): 2'-O-methylcytidine-5'-phosphate
  modified_base (16)..(16): 2'-O-methylcytidine-5'-phosphate
  modified_base (21)..(21): 2'-deoxy-thymidine-5'-phosphate-phosphorothioate
aanangagaannnaangagtt

SEQ ID NO: 978 - DNA, 21 bp, Artificial Sequence
  Description of Artificial Sequence: Synthetic oligonucleotide
  modified_base (14)..(14): 2'-O-methylcytidine-5'-phosphate
  modified_base (21)..(21): 2'-deoxy-thymidine-5'-phosphate-phosphorothioate
cucguugaguucunauguutt

SEQ ID NO: 979 - DNA, 21 bp, Artificial Sequence
  Description of Artificial Sequence: Synthetic oligonucleotide
  modified_base (2)..(2): 2'-O-methyluridine-5'-phosphate
  modified_base (4)..(4): 2'-O-methyluridine-5'-phosphate
  modified_base (8)..(9): 2'-O-methyluridine-5'-phosphate
  modified_base (11)..(11): 2'-O-methyluridine-5'-phosphate
  modified_base (12)..(12): 2'-O-methylcytidine-5'-phosphate
  modified_base (13)..(14): 2'-O-methyluridine-5'-phosphate
  modified_base (16)..(16): 2'-O-methyluridine-5'-phosphate
  modified_base (17)..(17): 2'-O-methylcytidine-5'-phosphate
  modified_base (21)..(21): 2'-deoxy-thymidine-5'-phosphate-phosphorothioate
anangggnnannnngnngatt

SEQ ID NO: 980 - DNA, 21 bp, Artificial Sequence
  Description of Artificial Sequence: Synthetic oligonucleotide
  modified_base (5)..(5): 2'-O-methylcytidine-5'-phosphate
  modified_base (10)..(10): 2'-O-methyluridine-5'-phosphate
  modified_base (15)..(15): 2'-O-methylcytidine-5'-phosphate
  modified_base (17)..(17): 2'-O-methyluridine-5'-phosphate
  modified_base (21)..(21): 2'-deoxy-thymidine-5'-phosphate-phosphorothioate
ucganaaganaaccnanautt

SEQ ID NO: 981 - DNA, 21 bp, Artificial Sequence
  Description of Artificial Sequence: Synthetic oligonucleotide
  modified_base (1)..(1): 2'-O-methyluridine-5'-phosphate
  modified_base (3)..(3): 2'-O-methylcytidine-5'-phosphate
  modified_base (4)..(4): 2'-O-methyluridine-5'-phosphate
  modified_base (6)..(6): 2'-O-methylcytidine-5'-phosphate
  modified_base (8)..(8): 2'-O-methyluridine-5'-phosphate
  modified_base (12)..(12): 2'-O-methyluridine-5'-phosphate
  modified_base (13)..(13): 2'-O-methylcytidine-5'-phosphate
  modified_base (16)..(16): 2'-O-methylcytidine-5'-phosphate
  modified_base (18)..(18): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
nannanangaanngananntt

SEQ ID NO: 982 - DNA, 21 bp, Artificial Sequence
  Description of Artificial Sequence: Synthetic oligonucleotide
  modified_base (11)..(11): 2'-O-methylcytidine-5'-phosphate
  modified_base (15)..(15): 2'-O-methyluridine-5'-phosphate
  modified_base (18)..(18): 2'-O-methyluridine-5'-phosphate
  modified_base (21)..(21): 2'-deoxy-thymidine-5'-phosphate-phosphorothioate
agugucgauunaugnagnatt

SEQ ID NO: 983 - DNA, 21 bp, Artificial Sequence
  Description of Artificial Sequence: Synthetic oligonucleotide
  modified_base (3)..(3): 2'-O-methyluridine-5'-phosphate
  modified_base (7)..(7): 2'-O-methyluridine-5'-phosphate
  modified_base (9)..(9): 2'-O-methyluridine-5'-phosphate
  modified_base (11)..(11): 2'-O-methylcytidine-5'-phosphate
  modified_base (14)..(14): 2'-O-methylcytidine-5'-phosphate
  modified_base (16)..(18): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
gangganananganannnntt

SEQ ID NO: 984 - DNA, 21 bp, Artificial Sequence
  Description of Artificial Sequence: Synthetic oligonucleotide
  modified_base (10)..(10): 2'-O-methyluridine-5'-phosphate
  modified_base (12)..(12): 2'-O-methyluridine-5'-phosphate
  modified_base (16)..(16): 2'-O-methylcytidine-5'-phosphate
  modified_base (21)..(21): 2'-deoxy-thymidine-5'-phosphate-phosphorothioate
agggugucgnanaucnauctt

SEQ ID NO: 985 - DNA, 21 bp, Artificial Sequence
  Description of Artificial Sequence: Synthetic oligonucleotide
  modified_base (3)..(5): 2'-O-methylcytidine-5'-phosphate
  modified_base (9)..(10): 2'-O-methyluridine-5'-phosphate
  modified_base (13)..(13): 2'-O-methylcytidine-5'-phosphate
  modified_base (15)..(15): 2'-O-methylcytidine-5'-phosphate
  modified_base (18)..(18): 2'-O-methyluridine-5'-phosphate
  modified_base (21)..(21): 2'-deoxy-thymidine-5'-phosphate-phosphorothioate
agnnnaaannaananggnatt

SEQ ID NO: 986 - DNA, 21 bp, Artificial Sequence
  Description of Artificial Sequence: Synthetic oligonucleotide
  modified_base (1)..(1): 2'-O-methyluridine-5'-phosphate
  modified_base (9)..(9): 2'-O-methyluridine-5'-phosphate
  modified_base (21)..(21): 2'-deoxy-thymidine-5'-phosphate-phosphorothioate
naccgugunaauuugggcutt

SEQ ID NO: 987 - DNA, 21 bp, Artificial Sequence
  Description of Artificial Sequence: Synthetic oligonucleotide
  modified_base (1)..(1): 2'-O-methyluridine-5'-phosphate
  modified_base (2)..(2): 2'-O-methylcytidine-5'-phosphate
  modified_base (3)..(3): 2'-O-methyluridine-5'-phosphate
  modified_base (5)..(5): 2'-O-methylcytidine-5'-phosphate
  modified_base (8)..(8): 2'-O-methyluridine-5'-phosphate
  modified_base (12)..(12): 2'-O-methyluridine-5'-phosphate
  modified_base (14)..(14): 2'-O-methyluridine-5'-phosphate
  modified_base (16)..(16): 2'-O-methylcytidine-5'-phosphate
  modified_base (19)..(19): 2'-O-methylcytidine-5'-phosphate
  modified_base (21)..(21): 2'-deoxy-thymidine-5'-phosphate-phosphorothioate
nnngnganggananangantt

SEQ ID NO: 988 - DNA, 21 bp, Artificial Sequence
  Description of Artificial Sequence: Synthetic oligonucleotide
  modified_base (5)..(5): 2'-O-methyluridine-5'-phosphate
  modified_base (7)..(7): 2'-O-methyluridine-5'-phosphate
  modified_base (11)..(11): 2'-O-methylcytidine-5'-phosphate
  modified_base (16)..(16): 2'-O-methylcytidine-5'-phosphate
  modified_base (21)..(21): 2'-deoxy-thymidine-5'-phosphate-phosphorothioate
gucgnanaucnaucgnagatt

SEQ ID NO: 989 - DNA, 21 bp, Artificial Sequence
  Description of Artificial Sequence: Synthetic oligonucleotide
  modified_base (1)..(1): 2'-O-methylcytidine-5'-phosphate
  modified_base (2)..(3): 2'-O-methyluridine-5'-phosphate
  modified_base (5)..(5): 2'-O-methylcytidine-5'-phosphate
  modified_base (6)..(6): 2'-O-methyluridine-5'-phosphate
  modified_base (8)..(8): 2'-O-methylcytidine-5'-phosphate
  modified_base (10)..(10): 2'-O-methyluridine-5'-phosphate
  modified_base (14)..(14): 2'-O-methyluridine-5'-phosphate
  modified_base (15)..(15): 2'-O-methylcytidine-5'-phosphate
  modified_base (18)..(18): 2'-O-methylcytidine-5'-phosphate
  modified_base (21)..(21): 2'-deoxy-thymidine-5'-phosphate-phosphorothioate
nnnannanangaannganatt

SEQ ID NO: 990 - DNA, 21 bp, Artificial Sequence
  Description of Artificial Sequence: Synthetic oligonucleotide
  modified_base (9)..(9): 2'-O-methylcytidine-5'-phosphate
  modified_base (13)..(13): 2'-O-methyluridine-5'-phosphate
  modified_base (16)..(16): 2'-O-methyluridine-5'-phosphate
  modified_base (21)..(21): 2'-deoxy-thymidine-5'-phosphate-phosphorothioate
ugucgauunaugnagnaagtt

SEQ ID NO: 991 - DNA, 21 bp, Artificial Sequence
  Description of Artificial Sequence: Synthetic oligonucleotide
  modified_base (1)..(1): 2'-O-methylcytidine-5'-phosphate
  modified_base (2)..(2): 2'-O-methyluridine-5'-phosphate
  modified_base (6)..(6): 2'-O-methylcytidine-5'-phosphate
  modified_base (7)..(7): 2'-O-methyluridine-5'-phosphate
  modified_base (12)..(14): 2'-O-methyluridine-5'-phosphate
  modified_base (16)..(16): 2'-O-methyluridine-5'-phosphate
  modified_base (19)..(19): 2'-O-methyluridine-5'-phosphate
  modified_base (21)..(21): 2'-deoxy-thymidine-5'-phosphate-phosphorothioate
nnaggnnagggnnnanagntt

SEQ ID NO: 992 - DNA, 21 bp, Artificial Sequence
  Description of Artificial Sequence: Synthetic oligonucleotide
  modified_base (3)..(3): 2'-O-methyluridine-5'-phosphate
  modified_base (5)..(5): 2'-O-methyluridine-5'-phosphate
  modified_base (12)..(12): 2'-O-methyluridine-5'-phosphate
  modified_base (17)..(17): 2'-O-methyluridine-5'-phosphate
  modified_base (21)..(21): 2'-deoxy-thymidine-5'-phosphate-phosphorothioate
acnanaaacccnagccnagtt

SEQ ID NO: 993 - DNA, 21 bp, Artificial Sequence
  Description of Artificial Sequence: Synthetic oligonucleotide
  modified_base (2)..(3): 2'-O-methylcytidine-5'-phosphate
  modified_base (11)..(11): 2'-O-methyluridine-5'-phosphate
  modified_base (13)..(14): 2'-O-methyluridine-5'-phosphate
  modified_base (16)..(18): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
annaaaagggnannannnntt

SEQ ID NO: 994 - DNA, 21 bp, Artificial Sequence
  Description of Artificial Sequence: Synthetic oligonucleotide
  modified_base (5)..(5): 2'-O-methyluridine-5'-phosphate
  modified_base (8)..(8): 2'-O-methyluridine-5'-phosphate
  modified_base (21)..(21): 2'-deoxy-thymidine-5'-phosphate-phosphorothioate
agggnaanacccuuuuggutt

SEQ ID NO: 995 - DNA, 21 bp, Artificial Sequence
  Description of Artificial Sequence: Synthetic oligonucleotide
  modified_base (1)..(1): 2'-O-methylcytidine-5'-phosphate
  modified_base (4)..(4): 2'-O-methyluridine-5'-phosphate
  modified_base (9)..(9): 2'-O-methylcytidine-5'-phosphate
  modified_base (11)..(11): 2'-O-methylcytidine-5'-phosphate
  modified_base (13)..(13): 2'-O-methyluridine-5'-phosphate
  modified_base (16)..(16): 2'-O-methyluridine-5'-phosphate
  modified_base (19)..(19): 2'-O-methyluridine-5'-phosphate
  modified_base (21)..(21): 2'-deoxy-thymidine-5'-phosphate-phosphorothioate
nagnagganananganggntt

SEQ ID NO: 996 - DNA, 21 bp, Artificial Sequence
  Description of Artificial Sequence: Synthetic oligonucleotide
  modified_base (3)..(3): 2'-O-methylcytidine-5'-phosphate
  modified_base (6)..(6): 2'-O-methylcytidine-5'-phosphate
  modified_base (15)..(15): 2'-O-methyluridine-5'-phosphate
  modified_base (21)..(21): 2'-deoxy-thymidine-5'-phosphate-phosphorothioate
acnaunauguguccnacugtt

SEQ ID NO: 997 - DNA, 21 bp, Artificial Sequence
  Description of Artificial Sequence: Synthetic oligonucleotide
  modified_base (2)..(2): 2'-O-methyluridine-5'-phosphate
  modified_base (7)..(7): 2'-O-methylcytidine-5'-phosphate
  modified_base (9)..(9): 2'-O-methylcytidine-5'-phosphate
  modified_base (11)..(11): 2'-O-methyluridine-5'-phosphate
  modified_base (14)..(14): 2'-O-methyluridine-5'-phosphate
  modified_base (17)..(17): 2'-O-methyluridine-5'-phosphate
  modified_base (21)..(21): 2'-deoxy-thymidine-5'-phosphate-phosphorothioate
gnagganananganggngatt

SEQ ID NO: 998 - DNA, 21 bp, Artificial Sequence
  Description of Artificial Sequence: Synthetic oligonucleotide
  modified_base (2)..(2): 2'-O-methylcytidine-5'-phosphate
  modified_base (5)..(5): 2'-O-methylcytidine-5'-phosphate
  modified_base (8)..(8): 2'-O-methylcytidine-5'-phosphate
  modified_base (17)..(17): 2'-O-methyluridine-5'-phosphate
  modified_base (21)..(21): 2'-deoxy-thymidine-5'-phosphate-phosphorothioate
unacnaunauguguccnactt

SEQ ID NO: 999 - DNA, 21 bp, Artificial Sequence
  Description of Artificial Sequence: Synthetic oligonucleotide
  modified_base (1)..(1): 2'-O-methyluridine-5'-phosphate
  modified_base (6)..(6): 2'-O-methylcytidine-5'-phosphate
  modified_base (8)..(8): 2'-O-methylcytidine-5'-phosphate
  modified_base (10)..(10): 2'-O-methyluridine-5'-phosphate
  modified_base (13)..(13): 2'-O-methyluridine-5'-phosphate
  modified_base (16)..(16): 2'-O-methyluridine-5'-phosphate
  modified_base (19)..(19): 2'-O-methyluridine-5'-phosphate
  modified_base (21)..(21): 2'-deoxy-thymidine-5'-phosphate-phosphorothioate
nagganananganggngantt

SEQ ID NO: 1000 - DNA, 21 bp, Artificial Sequence
  Description of Artificial Sequence: Synthetic oligonucleotide
  modified_base (3)..(3): 2'-O-methylcytidine-5'-phosphate
  modified_base (6)..(6): 2'-O-methylcytidine-5'-phosphate
  modified_base (9)..(9): 2'-O-methylcytidine-5'-phosphate
  modified_base (18)..(18): 2'-O-methyluridine-5'-phosphate
  modified_base (21)..(21): 2'-deoxy-thymidine-5'-phosphate-phosphorothioate
aunacnaunauguguccnatt

SEQ ID NO: 1001 - DNA, 21 bp, Artificial Sequence
  Description of Artificial Sequence: Synthetic oligonucleotide
  modified_base (3)..(3): 2'-O-methyluridine-5'-phosphate
  modified_base (6)..(6): 2'-O-methyluridine-5'-phosphate
  modified_base (9)..(12): 2'-O-methyluridine-5'-phosphate
  modified_base (13)..(14): 2'-O-methylcytidine-5'-phosphate
  modified_base (16)..(18): 2'-O-methyluridine-5'-phosphate
  modified_base (21)..(21): 2'-deoxy-thymidine-5'-phosphate-phosphorothioate
ganggngannnnnngnnngtt

SEQ ID NO: 1002 - DNA, 21 bp, Artificial Sequence
  Description of Artificial Sequence: Synthetic oligonucleotide
  modified_base (1)..(1): 2'-O-methylcytidine-5'-phosphate
  modified_base (13)..(13): 2'-O-methylcytidine-5'-phosphate
  modified_base (16)..(16): 2'-O-methylcytidine-5'-phosphate
  modified_base (21)..(21): 2'-deoxy-thymidine-5'-phosphate-phosphorothioate
naaacggaaaaunacnauctt

SEQ ID NO: 1003 - DNA, 21 bp, Artificial Sequence
  Description of Artificial Sequence: Synthetic oligonucleotide
  modified_base (1)..(1): 2'-O-methyluridine-5'-phosphate
  modified_base (4)..(4): 2'-O-methyluridine-5'-phosphate
  modified_base (7)..(10): 2'-O-methyluridine-5'-phosphate
  modified_base (11)..(12): 2'-O-methylcytidine-5'-phosphate
  modified_base (14)..(16): 2'-O-methyluridine-5'-phosphate
  modified_base (19)..(19): 2'-O-methyluridine-5'-phosphate
  modified_base (21)..(21): 2'-deoxy-thymidine-5'-phosphate-phosphorothioate
nggngannnnnngnnngantt

SEQ ID NO: 1004 - DNA, 21 bp, Artificial Sequence
  Description of Artificial Sequence: Synthetic oligonucleotide
  modified_base (3)..(3): 2'-O-methylcytidine-5'-phosphate
  modified_base (15)..(15): 2'-O-methylcytidine-5'-phosphate
  modified_base (18)..(18): 2'-O-methylcytidine-5'-phosphate
  modified_base (21)..(21): 2'-deoxy-thymidine-5'-phosphate-phosphorothioate
aunaaacggaaaaunacnatt

SEQ ID NO: 1005 - DNA, 21 bp, Artificial Sequence
  Description of Artificial Sequence: Synthetic oligonucleotide
  modified_base (1)..(1): 2'-O-methylcytidine-5'-phosphate
  modified_base (2)..(2): 2'-O-methyluridine-5'-phosphate
  modified_base (9)..(9): 2'-O-methylcytidine-5'-phosphate
  modified_base (12)..(12): 2'-O-methylcytidine-5'-phosphate
  modified_base (13)..(13): 2'-O-methyluridine-5'-phosphate
  modified_base (14)..(15): 2'-O-methylcytidine-5'-phosphate
  modified_base (18)..(18): 2'-O-methylcytidine-5'-phosphate
  modified_base (21)..(21): 2'-deoxy-thymidine-5'-phosphate-phosphorothioate
nngagaagnaannnnaanatt

SEQ ID NO: 1006 - DNA, 21 bp, Artificial Sequence
  Description of Artificial Sequence: Synthetic oligonucleotide
  modified_base (17)..(17): 2'-O-methylcytidine-5'-phosphate
  modified_base (21)..(21): 2'-deoxy-thymidine-5'-phosphate-phosphorothioate
uguuggaguugcuucunagtt

SEQ ID NO: 1007 - DNA, 21 bp, Artificial Sequence
  Description of Artificial Sequence: Synthetic oligonucleotide
  modified_base (1)..(1): 2'-O-methyluridine-5'-phosphate
  modified_base (8)..(8): 2'-O-methylcytidine-5'-phosphate
  modified_base (11)..(11): 2'-O-methylcytidine-5'-phosphate
  modified_base (12)..(12): 2'-O-methyluridine-5'-phosphate
  modified_base (13)..(14): 2'-O-methylcytidine-5'-phosphate
  modified_base (17)..(17): 2'-O-methylcytidine-5'-phosphate
  modified_base (21)..(21): 2'-deoxy-thymidine-5'-phosphate-phosphorothioate
ngagaagnaannnnaanaatt

SEQ ID NO: 1008 - DNA, 21 bp, Artificial Sequence
  Description of Artificial Sequence: Synthetic oligonucleotide
  modified_base (18)..(18): 2'-O-methylcytidine-5'-phosphate
  modified_base (21)..(21): 2'-deoxy-thymidine-5'-phosphate-phosphorothioate
uuguuggaguugcuucunatt

SEQ ID NO: 1009 - DNA, 21 bp, Artificial Sequence
  Description of Artificial Sequence: Synthetic oligonucleotide
  modified_base (6)..(6): 2'-O-methylcytidine-5'-phosphate
  modified_base (9)..(9): 2'-O-methylcytidine-5'-phosphate
  modified_base (10)..(10): 2'-O-methyluridine-5'-phosphate
  modified_base (11)..(12): 2'-O-methylcytidine-5'-phosphate
  modified_base (15)..(15): 2'-O-methylcytidine-5'-phosphate
  modified_base (18)..(18): 2'-O-methyluridine-5'-phosphate
  modified_base (21)..(21): 2'-deoxy-thymidine-5'-phosphate-phosphorothioate
agaagnaannnnaanaanatt

SEQ ID NO: 1010 - DNA, 21 bp, Artificial Sequence
  Description of Artificial Sequence: Synthetic oligonucleotide
  modified_base (1)..(1): 2'-O-methyluridine-5'-phosphate
  modified_base (21)..(21): 2'-deoxy-thymidine-5'-phosphate-phosphorothioate
nauuguuggaguugcuucutt

SEQ ID NO: 1011 - DNA, 21 bp, Artificial Sequence
  Description of Artificial Sequence: Synthetic oligonucleotide
  modified_base (4)..(4): 2'-O-methyluridine-5'-phosphate
  modified_base (7)..(7): 2'-O-methyluridine-5'-phosphate
  modified_base (13)..(14): 2'-O-methyluridine-5'-phosphate
  modified_base (21)..(21): 2'-deoxy-thymidine-5'-phosphate-phosphorothioate
aagngangaagannaagaatt

SEQ ID NO: 1012 - DNA, 21 bp, Artificial Sequence
  Description of Artificial Sequence: Synthetic oligonucleotide
  modified_base (5)..(5): 2'-O-methyluridine-5'-phosphate
  modified_base (12)..(12): 2'-O-methylcytidine-5'-phosphate
  modified_base (15)..(15): 2'-O-methylcytidine-5'-phosphate
  modified_base (21)..(21): 2'-deoxy-thymidine-5'-phosphate-phosphorothioate
uucunaaucuunaunacuutt

SEQ ID NO: 1013 - DNA, 21 bp, Artificial Sequence
  Description of Artificial Sequence: Synthetic oligonucleotide
  modified_base (3)..(3): 2'-O-methyluridine-5'-phosphate
  modified_base (6)..(6): 2'-O-methyluridine-5'-phosphate
  modified_base (12)..(13): 2'-O-methyluridine-5'-phosphate
  modified_base (21)..(21): 2'-deoxy-thymidine-5'-phosphate-phosphorothioate
agngangaagannaagaaatt

SEQ ID NO: 1014 - DNA, 21 bp, Artificial Sequence
  Description of Artificial Sequence: Synthetic oligonucleotide
  modified_base (6)..(6): 2'-O-methyluridine-5'-phosphate
  modified_base (13)..(13): 2'-O-methylcytidine-5'-phosphate
  modified_base (16)..(16): 2'-O-methylcytidine-5'-phosphate
  modified_base (21)..(21): 2'-deoxy-thymidine-5'-phosphate-phosphorothioate
uuucunaaucuunaunacutt

SEQ ID NO: 1015 - DNA, 21 bp, Artificial Sequence
  Description of Artificial Sequence: Synthetic oligonucleotide
  modified_base (1)..(1): 2'-O-methylcytidine-5'-phosphate
  modified_base (2)..(2): 2'-O-methyluridine-5'-phosphate
  modified_base (4)..(5): 2'-O-methylcytidine-5'-phosphate
  modified_base (6)..(6): 2'-O-methyluridine-5'-phosphate
  modified_base (8)..(8): 2'-O-methylcytidine-5'-phosphate
  modified_base (9)..(9): 2'-O-methyluridine-5'-phosphate
  modified_base (11)..(11): 2'-O-methylcytidine-5'-phosphate
  modified_base (14)..(14): 2'-O-methylcytidine-5'-phosphate
  modified_base (16)..(16): 2'-O-methyluridine-5'-phosphate
  modified_base (21)..(21): 2'-deoxy-thymidine-5'-phosphate-phosphorothioate
nngnnngnngnaananggatt

SEQ ID NO: 1016 - DNA, 21 bp, Artificial Sequence
  Description of Artificial Sequence: Synthetic oligonucleotide
  modified_base (3)..(3): 2'-O-methylcytidine-5'-phosphate
  modified_base (10)..(10): 2'-O-methylcytidine-5'-phosphate
  modified_base (13)..(13): 2'-O-methylcytidine-5'-phosphate
  modified_base (17)..(17): 2'-O-methylcytidine-5'-phosphate
  modified_base (21)..(21): 2'-deoxy-thymidine-5'-phosphate-phosphorothioate
ucnauguugnagnaggnagtt

SEQ ID NO: 1017 - DNA, 21 bp, Artificial Sequence
  Description of Artificial Sequence: Synthetic oligonucleotide
  modified_base (3)..(3): 2'-O-methylcytidine-5'-phosphate
  modified_base (4)..(4): 2'-O-methyluridine-5'-phosphate
  modified_base (10)..(10): 2'-O-methylcytidine-5'-phosphate
  modified_base (11)..(11): 2'-O-methyluridine-5'-phosphate
  modified_base (13)..(13): 2'-O-methylcytidine-5'-phosphate
  modified_base (14)..(14): 2'-O-methyluridine-5'-phosphate
  modified_base (16)..(16): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
ggnngaaaanngnnanaantt

SEQ ID NO: 1018 - DNA, 21 bp, Artificial Sequence
  Description of Artificial Sequence: Synthetic oligonucleotide
  modified_base (5)..(5): 2'-O-methyluridine-5'-phosphate
  modified_base (8)..(8): 2'-O-methylcytidine-5'-phosphate
  modified_base (15)..(15): 2'-O-methylcytidine-5'-phosphate
  modified_base (21)..(21): 2'-deoxy-thymidine-5'-phosphate-phosphorothioate
auugnagnaguuuunagcctt

SEQ ID NO: 1019 - DNA, 21 bp, Artificial Sequence
  Description of Artificial Sequence: Synthetic oligonucleotide
  modified_base (3)..(3): 2'-O-methyluridine-5'-phosphate
  modified_base (9)..(10): 2'-O-methyluridine-5'-phosphate
  modified_base (15)..(16): 2'-O-methylcytidine-5'-phosphate
  modified_base (17)..(18): 2'-O-methyluridine-5'-phosphate
  modified_base (19)..(19): 2'-O-methylcytidine-5'-phosphate
  modified_base (21)..(21): 2'-deoxy-thymidine-5'-phosphate-phosphorothioate
gangaagannaaaannnnntt

SEQ ID NO: 1020 - DNA, 21 bp, Artificial Sequence
  Description of Artificial Sequence: Synthetic oligonucleotide
  modified_base (6)..(8): 2'-O-methyluridine-5'-phosphate
  modified_base (14)..(14): 2'-O-methyluridine-5'-phosphate
  modified_base (16)..(16): 2'-O-methylcytidine-5'-phosphate
  modified_base (21)..(21): 2'-deoxy-thymidine-5'-phosphate-phosphorothioate
gaaggnnnuaaucnunauctt

SEQ ID NO: 1021 - DNA, 21 bp, Artificial Sequence
  Description of Artificial Sequence: Synthetic oligonucleotide
  modified_base (2)..(2): 2'-O-methyluridine-5'-phosphate
  modified_base (8)..(9): 2'-O-methyluridine-5'-phosphate
  modified_base (14)..(15): 2'-O-methylcytidine-5'-phosphate
  modified_base (16)..(17): 2'-O-methyluridine-5'-phosphate
  modified_base (18)..(18): 2'-O-methylcytidine-5'-phosphate
  modified_base (21)..(21): 2'-deoxy-thymidine-5'-phosphate-phosphorothioate
angaagannaaaannnnnatt

SEQ ID NO: 1022 - DNA, 21 bp, Artificial Sequence
  Description of Artificial Sequence: Synthetic oligonucleotide
  modified_base (1)..(1): 2'-O-methyluridine-5'-phosphate
  modified_base (7)..(9): 2'-O-methyluridine-5'-phosphate
  modified_base (15)..(15): 2'-O-methyluridine-5'-phosphate
  modified_base (17)..(17): 2'-O-methylcytidine-5'-phosphate
  modified_base (21)..(21): 2'-deoxy-thymidine-5'-phosphate-phosphorothioate
ngaaggnnnuaaucnunautt

SEQ ID NO: 1023 - DNA, 21 bp, Artificial Sequence
  Description of Artificial Sequence: Synthetic oligonucleotide
  modified_base (1)..(1): 2'-O-methyluridine-5'-phosphate
  modified_base (7)..(8): 2'-O-methyluridine-5'-phosphate
  modified_base (13)..(14): 2'-O-methylcytidine-5'-phosphate
  modified_base (15)..(16): 2'-O-methyluridine-5'-phosphate
  modified_base (17)..(17): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
ngaagannaaaannnnnantt

SEQ ID NO: 1024 - DNA, 21 bp, Artificial Sequence
  Description of Artificial Sequence: Synthetic oligonucleotide
  modified_base (2)..(2): 2'-O-methyluridine-5'-phosphate
  modified_base (8)..(11): 2'-O-methyluridine-5'-phosphate
  modified_base (16)..(16): 2'-O-methyluridine-5'-phosphate
  modified_base (18)..(18): 2'-O-methylcytidine-5'-phosphate
  modified_base (21)..(21): 2'-deoxy-thymidine-5'-phosphate-phosphorothioate
angaaggnnnnaaucnunatt

SEQ ID NO: 1025 - DNA, 21 bp, Artificial Sequence
  Description of Artificial Sequence: Synthetic oligonucleotide
  modified_base (6)..(7): 2'-O-methyluridine-5'-phosphate
  modified_base (12)..(13): 2'-O-methylcytidine-5'-phosphate
  modified_base (14)..(15): 2'-O-methyluridine-5'-phosphate
  modified_base (16)..(16): 2'-O-methylcytidine-5'-phosphate
  modified_base (18)..(18): 2'-O-methyluridine-5'-phosphate
  modified_base (19)..(19): 2'-O-methylcytidine-5'-phosphate
  modified_base (21)..(21): 2'-deoxy-thymidine-5'-phosphate-phosphorothioate
gaagannaaaannnnnanntt

SEQ ID NO: 1026 - DNA, 21 bp, Artificial Sequence
  Description of Artificial Sequence: Synthetic oligonucleotide
  modified_base (3)..(3): 2'-O-methyluridine-5'-phosphate
  modified_base (9)..(12): 2'-O-methyluridine-5'-phosphate
  modified_base (17)..(17): 2'-O-methyluridine-5'-phosphate
  modified_base (21)..(21): 2'-deoxy-thymidine-5'-phosphate-phosphorothioate
gangaaggnnnnaaucnuctt

SEQ ID NO: 1027 - DNA, 21 bp, Artificial Sequence
  Description of Artificial Sequence: Synthetic oligonucleotide
  modified_base (1)..(1): 2'-O-methyluridine-5'-phosphate
  modified_base (4)..(4): 2'-O-methyluridine-5'-phosphate
  modified_base (10)..(11): 2'-O-methyluridine-5'-phosphate
  modified_base (21)..(21): 2'-deoxy-thymidine-5'-phosphate-phosphorothioate
ngangaagannaagaaaaatt

SEQ ID NO: 1028 - DNA, 21 bp, Artificial Sequence
  Description of Artificial Sequence: Synthetic oligonucleotide
  modified_base (1)..(4): 2'-O-methyluridine-5'-phosphate
  modified_base (7)..(8): 2'-O-methyluridine-5'-phosphate
  modified_base (13)..(13): 2'-O-methyluridine-5'-phosphate
  modified_base (15)..(15): 2'-O-methylcytidine-5'-phosphate
  modified_base (18)..(18): 2'-O-methylcytidine-5'-phosphate
  modified_base (21)..(21): 2'-deoxy-thymidine-5'-phosphate-phosphorothioate
nnnnucnnaaucnunaunatt

SEQ ID NO: 1029 - DNA, 21 bp, Artificial Sequence
  Description of Artificial Sequence: Synthetic oligonucleotide
  modified_base (5)..(6): 2'-O-methyluridine-5'-phosphate
  modified_base (11)..(12): 2'-O-methylcytidine-5'-phosphate
  modified_base (13)..(14): 2'-O-methyluridine-5'-phosphate
  modified_base (15)..(15): 2'-O-methylcytidine-5'-phosphate
  modified_base (17)..(17): 2'-O-methyluridine-5'-phosphate
  modified_base (18)..(18): 2'-O-methylcytidine-5'-phosphate
  modified_base (21)..(21): 2'-deoxy-thymidine-5'-phosphate-phosphorothioate
aagannaaaannnnnannatt

SEQ ID NO: 1030 - DNA, 21 bp, Artificial Sequence
  Description of Artificial Sequence: Synthetic oligonucleotide
  modified_base (1)..(1): 2'-O-methyluridine-5'-phosphate
  modified_base (4)..(4): 2'-O-methyluridine-5'-phosphate
  modified_base (10)..(13): 2'-O-methyluridine-5'-phosphate
  modified_base (18)..(18): 2'-O-methyluridine-5'-phosphate
  modified_base (21)..(21): 2'-deoxy-thymidine-5'-phosphate-phosphorothioate
ngangaaggnnnnaaucnutt

SEQ ID NO: 1031 - DNA, 21 bp, Artificial Sequence
  Description of Artificial Sequence: Synthetic oligonucleotide
  modified_base (4)..(5): 2'-O-methyluridine-5'-phosphate
  modified_base (10)..(11): 2'-O-methylcytidine-5'-phosphate
  modified_base (12)..(13): 2'-O-methyluridine-5'-phosphate
  modified_base (14)..(14): 2'-O-methylcytidine-5'-phosphate
  modified_base (16)..(16): 2'-O-methyluridine-5'-phosphate
  modified_base (17)..(17): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
agannaaaannnnnannantt

SEQ ID NO: 1032 - DNA, 21 bp, Artificial Sequence
  Description of Artificial Sequence: Synthetic oligonucleotide
  modified_base (2)..(2): 2'-O-methyluridine-5'-phosphate
  modified_base (5)..(5): 2'-O-methyluridine-5'-phosphate
  modified_base (11)..(14): 2'-O-methyluridine-5'-phosphate
  modified_base (21)..(21): 2'-deoxy-thymidine-5'-phosphate-phosphorothioate
angangaaggnnnnaaucutt

SEQ ID NO: 1033 - DNA, 21 bp, Artificial Sequence
  Description of Artificial Sequence: Synthetic oligonucleotide
  modified_base (3)..(4): 2'-O-methyluridine-5'-phosphate
  modified_base (9)..(10): 2'-O-methylcytidine-5'-phosphate
  modified_base (11)..(12): 2'-O-methyluridine-5'-phosphate
  modified_base (13)..(13): 2'-O-methylcytidine-5'-phosphate
  modified_base (15)..(15): 2'-O-methyluridine-5'-phosphate
  modified_base (16)..(16): 2'-O-methylcytidine-5'-phosphate
  modified_base (18)..(18): 2'-O-methyluridine-5'-phosphate
  modified_base (19)..(19): 2'-O-methylcytidine-5'-phosphate
  modified_base (21)..(21): 2'-deoxy-thymidine-5'-phosphate-phosphorothioate
gannaaaannnnnannanntt

SEQ ID NO: 1034 - DNA, 21 bp, Artificial Sequence
  Description of Artificial Sequence: Synthetic oligonucleotide
  modified_base (3)..(3): 2'-O-methyluridine-5'-phosphate
  modified_base (6)..(6): 2'-O-methyluridine-5'-phosphate
  modified_base (12)..(15): 2'-O-methyluridine-5'-phosphate
  modified_base (21)..(21): 2'-deoxy-thymidine-5'-phosphate-phosphorothioate
gangangaaggnnnnaauctt

SEQ ID NO: 1035 - DNA, 21 bp, Artificial Sequence
  Description of Artificial Sequence: Synthetic oligonucleotide
  modified_base (2)..(3): 2'-O-methyluridine-5'-phosphate
  modified_base (8)..(9): 2'-O-methylcytidine-5'-phosphate
  modified_base (10)..(11): 2'-O-methyluridine-5'-phosphate
  modified_base (12)..(12): 2'-O-methylcytidine-5'-phosphate
  modified_base (14)..(14): 2'-O-methyluridine-5'-phosphate
  modified_base (15)..(15): 2'-O-methylcytidine-5'-phosphate
  modified_base (17)..(17): 2'-O-methyluridine-5'-phosphate
  modified_base (18)..(19): 2'-O-methylcytidine-5'-phosphate
  modified_base (21)..(21): 2'-deoxy-thymidine-5'-phosphate-phosphorothioate
annaaaannnnnannannntt

SEQ ID NO: 1036 - DNA, 21 bp, Artificial Sequence
  Description of Artificial Sequence: Synthetic oligonucleotide
  modified_base (4)..(4): 2'-O-methyluridine-5'-phosphate
  modified_base (7)..(7): 2'-O-methyluridine-5'-phosphate
  modified_base (13)..(16): 2'-O-methyluridine-5'-phosphate
  modified_base (21)..(21): 2'-deoxy-thymidine-5'-phosphate-phosphorothioate
ggangangaaggnnnnaautt

SEQ ID NO: 1037 - DNA, 21 bp, Artificial Sequence
  Description of Artificial Sequence: Synthetic oligonucleotide
  modified_base (1)..(2): 2'-O-methyluridine-5'-phosphate
  modified_base (7)..(8): 2'-O-methylcytidine-5'-phosphate
  modified_base (9)..(10): 2'-O-methyluridine-5'-phosphate
  modified_base (11)..(11): 2'-O-methylcytidine-5'-phosphate
  modified_base (13)..(13): 2'-O-methyluridine-5'-phosphate
  modified_base (14)..(14): 2'-O-methylcytidine-5'-phosphate
  modified_base (16)..(16): 2'-O-methyluridine-5'-phosphate
  modified_base (17)..(18): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
nnaaaannnnnannannnntt

SEQ ID NO: 1038 - DNA, 21 bp, Artificial Sequence
  Description of Artificial Sequence: Synthetic oligonucleotide
  modified_base (5)..(5): 2'-O-methyluridine-5'-phosphate
  modified_base (8)..(8): 2'-O-methyluridine-5'-phosphate
  modified_base (14)..(17): 2'-O-methyluridine-5'-phosphate
  modified_base (21)..(21): 2'-deoxy-thymidine-5'-phosphate-phosphorothioate
aggangangaaggnnnnaatt

SEQ ID NO: 1039 - DNA, 21 bp, Artificial Sequence
  Description of Artificial Sequence: Synthetic oligonucleotide
  modified_base (1)..(1): 2'-O-methyluridine-5'-phosphate
  modified_base (6)..(7): 2'-O-methylcytidine-5'-phosphate
  modified_base (8)..(9): 2'-O-methyluridine-5'-phosphate
  modified_base (10)..(10): 2'-O-methylcytidine-5'-phosphate
  modified_base (12)..(12): 2'-O-methyluridine-5'-phosphate
  modified_base (13)..(13): 2'-O-methylcytidine-5'-phosphate
  modified_base (15)..(15): 2'-O-methyluridine-5'-phosphate
  modified_base (16)..(17): 2'-O-methylcytidine-5'-phosphate
  modified_base (18)..(19): 2'-O-methyluridine-5'-phosphate
  modified_base (21)..(21): 2'-deoxy-thymidine-5'-phosphate-phosphorothioate
naaaannnnnannannnnntt

SEQ ID NO: 1040 - DNA, 21 bp, Artificial Sequence
  Description of Artificial Sequence: Synthetic oligonucleotide
  modified_base (6)..(6): 2'-O-methyluridine-5'-phosphate
  modified_base (9)..(9): 2'-O-methyluridine-5'-phosphate
  modified_base (15)..(18): 2'-O-methyluridine-5'-phosphate
  modified_base (21)..(21): 2'-deoxy-thymidine-5'-phosphate-phosphorothioate
aaggangangaaggnnnnatt

SEQ ID NO: 1041 - DNA, 21 bp, Artificial Sequence
  Description of Artificial Sequence: Synthetic oligonucleotide
  modified_base (3)..(3): 2'-O-methyluridine-5'-phosphate
  modified_base (9)..(10): 2'-O-methyluridine-5'-phosphate
  modified_base (21)..(21): 2'-deoxy-thymidine-5'-phosphate-phosphorothioate
gangaagannaagaaaaagtt

SEQ ID NO: 1042 - DNA, 21 bp, Artificial Sequence
  Description of Artificial Sequence: Synthetic oligonucleotide
  modified_base (2)..(5): 2'-O-methyluridine-5'-phosphate
  modified_base (8)..(9): 2'-O-methyluridine-5'-phosphate
  modified_base (14)..(14): 2'-O-methyluridine-5'-phosphate
  modified_base (16)..(16): 2'-O-methylcytidine-5'-phosphate
  modified_base (21)..(21): 2'-deoxy-thymidine-5'-phosphate-phosphorothioate
cnnnnucnnaaucnunauctt

SEQ ID NO: 1043 - DNA, 2998 bp, Artificial Sequence
  Description of Artificial Sequence: Synthetic polynucleotide
ggtaccctcgaggaggaagattaataattttcctctcattgaaatttatatcggaatttaaattgaaattgttactgtaatcacacctggtttgtttcagagccacatcacaaagatagagaacaacctaggtctccgaagggagcaagggcatcagtgtgctcagttgaaaatcccttgtcaacacctaggtcttatcacatcacaagttccacctcagactctgcagggtgatccaacaaccttaatagaaacattattgttaaaggacagcattagttcacagtcaaacaagcaagattgagaattaaccttggttttgaacttgaacacttaggggattgaagattcaacaaccctaaagcttggggtaaaacattggaaatagttaaaagacaaattgctcgggtttacctgagagcctacaacatggataaacgggtgagaggttcattggcgccgagtctcactgaatctgacatggattaccacaagatcttgacagcaggtctgtccgttcaacaggggattgttcggcaaagagtcatcccagtgtatcaagtaaacaatcttgaagaaatttgccaacttatcatacaggcctttgaagcaggtgttgattttcaagagagtgcggacagtttccttctcatgctttgtcttcatcatgcgtaccagggagattacaaacttttcttggaaagtggcgcagtcaagtatttggaagggcacgggttccgttttgaagtcaagaagcgtgatggagtgaagcgccttgaggaattgctgccagcagtatctagtggaaaaaacattaagagaacacttgctgccatgccggaagaggagacaactgaagctaatgccggtcagtttctctcctttgcaagtctatttctacccaaacttgtcgttggagaaaaggcttgccttgagaaggttcaaaggcaaattcaagtacatgcagagcaaggactgatacaatatccaacagcttggcaatcagtaggacacatgatggtgattttccgtttgatgcgaacaaattttctgatcaaatttctcctaatacaccaagggatgcacatggttgccgggcatgatgccaacgatgctgtgatttcaaattcagtggctcaagctcgtttttcaggcttattgattgtcaaaacagtacttgatcatatcctacaaaagacagaacgaggagttcgtctccatcctcttgcaaggaccgccaaggtaaaaaatgaggtgaactcctttaaggctgcactcagctccctggccaagcatggagagtatgctcctttcgcccgacttttgaacctttctggagtaaataatcttgagcatggtcttttccctcaactatcggcaattgcactcggagtcgccacagcacacgggagtaccctcgcaggagtaaatgttggagaacagtatcaacaactcagagaggctgccactgaggctgagaagcaactccaacaatacgcagagtctcgcgaacttgaccatcttggacttgatgatcaggaaaagaaaattcttatgaacttccatcagaaaaagaacgaaatcagcttccagcaaacaaacgctatggtaactctaagaaaagagcgcctggccaagctgacagaagctatcactgctgcgtcactgcccaaaacaagtggacattacgatgatgatgacgacattccatttcccgggccgatctatgatgacgacaatcctggccatcaagatgatgatccgactgactcacaggatacgaccattcccgatggtgttgttgacccgtatgatggaagctacggcgaatatcctgactacgaggattcggctgaaggtgcaccagatgacttggtcctattcgatctagacgaggacgacgaggacactaagccagtgcctaatagatcgaccaagggtggacaacagaagaacagtcaaaagggccagcatatagagggcagacagatccgaccttggacggagcgaaaaaggtgccggagttgcagaacaatccaccacgccagtgcgccactcacggacaatgacagaagaaatgaaccctccggctcaaccagccctcgcatgctgacaccaattaacgaagaggcagacccactggacgatgccgacgacgagagtctcacatccctgcccttggagtcagatgatgaagagcaggacagggacggaacttccaaccgcacacccactgtcgccccaccggctcccgtatacagagatcactctgaaaagaaagaactcccgcaagacgagcaacaagatcaggaccacactcaagaggccaggaaccaggacagtgacaacacccagtcagaacactcttttgaggagatgtatcgccacattctaagatcacaggggccatttgatgctgttttgtattatcacctaatgagtgatgagcctgtagttttcagtaccagtgatggcaaagagtacacgtatccagactcccttgaagaggaatatccaccatggctcactgaaaaagaggctatgaatgaagagaatagatttgttacattggatggtcaacaattttattggccggtgatgaatcacaagaataaattcatggcaatcctgcaacatcatcagtgaatgagcatggaacaatgggatgattcaaccgacaaatagctaacattaagtagtcaaggaacgaaaacaggaagaatttttgatgtctaaggtgtgaattattatcacaataaaagtgattcttatttttgaatttaaagctagcttattattactagccgtttttcaaagttcaatttgagtcttaatgcaaataggcgttaagccacagttatagccataattgtaactcaatattctaactagcgatttatctaaattaaattacattatgcttttataacttacctactagcctgcccaacatttacacgatcgttttataattaagaaaaaagcggccgcagagctc

SEQ ID NO: 1044 - DNA, 2373 bp, Artificial Sequence
  Description of Artificial Sequence: Synthetic polynucleotide
ggtaccctcgaggatgaagattaagccgacagtgagcgtaatcttcatctctcttagattatttgttttccagagtaggggtcgtcaggtccttttcaatcgtgtaaccaaaataaactccactagaaggatattgtggggcaacaacacaatgggcgttcttagcctactccaattgcctcgtgatcgattcaagaggacatcattctttctttgggtaattatccttttccaaagaacattttccatcccacttggagtcatccacaatagcacattacaggttagtgagattgaccagctagtctgcaaggatcatactgatatgccatctgcaactaaaagatggggcttcaggtccggtgtcccaccaaaggtggtcaattatgaagctggtgaatgggctgaaaactgctacaatcttgaaatcaaaaaaccggacgggagcgaatgcttacccgcagcgccagacgggattcggggcttcccccggtgccggtatgtgcacaaagtatcaggaacgggaccgtgtgccggagactttgccttccataaagagggtgctttcttcctgtatgatcgacttgcttccacagttatctaccgaggaacgactttcgctgaaggtgtcgttgcatttctgatactgccccaagctaagaaggacttcttcagctcacaccccttgagagagccggtcaatgcaacggaggacccgtctagtggctactattctaccacaattagatatcaggctaccggttttggaaccaatgagacagagtacttgttcgaggttgacaatttgacctacgtccaacttgaatcaagattcacaccacagtttctgctccagctgaatgagacaatatatacaagtgggaaaaggagcaataccacgggaaaactaatttggaaggtcaaccccgaaattgatacaacaatcggggagtgggccttctgggaaactaaaaaaacctcactagaaaaattcgcagtgaagagttgtctttcacagttttatcgctcaacgagacagacatcagtggtcagagtccggcgcgaacttcttccggaagaatctccgaccgggccactgaagaccacaaaatcatggcttcagaaaattcctctgcaatggttcaagtgcacagtcaaggaagggaaacaacattgccgtctcagaattcgacagaaggtcgaagagcgagtccccaatccctcacaaccaaaccaggtccggacaacagcacccataatacacccgtgtataaacttgacatctctgaggcaactcaagttgaacaacatcaccgcagaacagacaacgacagcacagcctccgacactccctctgccacgaccgcagccggacccccaaaagcagagaacaccaacacgagcaagagcactgacttcctggaccccgccaccacaacaagtccccaaaaccacagcgagaccgctggcaacaacaacactcatcaccaagataccggagaagagagtgccagcagcgggaagctaggcttaattaccaatactattgctggagtcgcaggactgatcacaggcgggagaagaactcgaagagaagcaattgtcaatgctcaacccaaatgcaaccctaatttacattactggactactcaggatgaaggtgctgcaatcggactggcctggataccatatttcgggccagcagccgagggaatttacatagaggggctaatgcacaatcaagatggtttaatctgtgggttgagacagctggccaacgagacgactcaagctcttcaactgttcctgagagccacaacggagctgcggacatataccatactcaaccgtaaggcaattgatttcttgctgcagcgatggggcggcacatgccacattctgggaccggactgctgtatcgaaccacatgattggaccaagaacataacagacaaaattgatcagattattcatgattttgttgataaaacccttccggaccagggggacaatgacaattggtggacaggatggagacaatggataccggcaggtattggagttacaggcgttataattgcagttatcgctttattctgtatatgcaaatttgtcttttagtttttcttcagattgcttcatggaaaagctcagcctcaaatcaatgaaaccaggatttaattatatggattacttgaatctaagattacttgacaaatgataatataatacactggagctttaaacatagccaatgtgattctaactcctttaaactcacagttaatcataaacaaggtttgacatcaatctagttatctctttgagaatgataaacttgatgaagattaagaaaaagcggccgcagagctc

SEQ ID NO: 1045 - DNA, 1664 bp, Filovirus
ggcgcgcctcgaggatgaagattaatgcggaggtctgataagaataaaccttattattcagattaggccccaagaggcattcttcatctccttttagcaaagtactatttcagggtagtccaattagtggcacgtcttttagctgtatatcagtcgcccctaggctagggtttatagttgtctctaagctaaattggtcttgaactagtctactcgcagaatcctaccgggaatagactaattgaacttagccgtttaaaatttagtgcataaatctgggctaacaccaccaggtcaactccattggctgaaaagaagcttacctacaacgaacatcactttgagcgccctcacaattaaaaaataggaacgtcgttccaacaatcgagcgcaaggtttcaatattatacgggtccattaatttcaacaaaatattgatactccagacaccaagcaagacctgagaaaaaaccatggctaaagctacgggacgatacaatctaatatcgcccaaaaaggacctggagaaaggggttgtcttaagcgacctctgtaacttcttagttagccaaactattcaggggtggaaggtttattgggctggtattgagtttgatgtgaaccaaaagggtattaccctattgcatagactgaaaactaatgactttgcccctgcatggtcaatgacaaggaatctctttcctcatttatttcaaaatccgaattccacaattgaatcaccgctgtgggcattgagagtcatccttgcagcagggatacaggaccagctgattgaccagtctttgattgaacccttagcaggagcccttggtctgatctctgattggctgctaacaaccaacactaaccatttcaacatgcgaacacaacgtgtcaaggaacaattgagcctaaaaatgctgtcgttgattcgatccaatattctcaagtttattaacaaattggatgctctacatgtcgtgaactacaacggattgttgagcagtattgaaattggaactcaaaatcatacaatcatcataactcggactaatatgggttatcttgtcgagctccaagaacccgacaaatctgcgatggatatacgacaccctgggccggcgaaattttccttactacatgaatcgacacttaaagcatttacacaaggatcctcgacacgaatgcaaagtttgattcttgaatttaatagctctcttgctatctaactaaggtagaaaaaattgtacgatagggctaacattatgctgactcaatagttatcttgacatctctgctttcataatcagatatataagcataataaataaatactcatatttcttgataatttgtttaaccacagataaatcctcactgtaagccagcttccaagttgacacccttacaaaaaccaggactcagaatccctcaaacaagagattccaagacaacatcatagaattgctttattatatgaataagcattttatcaccagaaatcctatatactaaatggttaattgtaactgaacccgcaggtcacatgtgttaggtttcacagattctatatattactaactctagagcccaaattaacacggtataagtagattaagaaaaaagcctgaggaagattaagaaaaagcggccgcattaattaa

SEQ ID NO: 1046 - DNA, 1483 bp, Filovirus
ggcgcgcctcgaggatgaagattaagaaaaaggtaatctttcgattatctttaatcttcatccttgattctacaatcatgacagttgtctttagtgacaagggaaagaagcctttttattaagttgtaataatcagatctgcgaaccggtagagtttagttgcaacctaacacacataaagcattggtcaaaaagtcaatagaaatttaaacagtgagtggagacaacttttaaatggaagcttcgtgagcgcgggagatcaaggaattcacgtgccgaccagcaagggatggacacgaccaccatgttcgagcacgatcatcatccagagagaattatcgaggtgagtaccgtcaatcaaggagcgcctcacaagtgcgcgttcctactgtatttcataagaagagagttgaaccattaacagttcctccagcacctaaagacatatgtccgaccttgaaaaaaggatttttgtgtgacagtagtttttgcaaaaaagatcaccagcttgaaagcctaaccgaccgggaattactcctactaatcgcccgtaagacttgtggatcagttgattcatcgcttaatataactgcacccaaggactcgcgcttagcaaatccaacggctgatgatttccagcaagaggaaggtccaaaaaattactagtcgagactgctcaagacggcagaacactgggcgagacaagacatcagaaccatagaggattcaaaattaagagcattgttgactctatgtgctgtgatgacgaggaaattctcaaaatcccagctgagtcttttatgtgagacacacctaaggcgcgaggggcttgggcaagatcaggcagaacccgttctcgaagtatatcaacgattacacagtgataaaggaggcagttttgaagctgcactatggcaacaatgggaccgacaatccctaattatgtttatcactgcattcttgaatattgctctccagttaccgtgtgaaagttctgctgtcgttgtttcaggcctacgcttacttgcccccccaagcgttaatgaagaagcttcaaccaacccggggacatgctcatggtctgatgagggtaccccttaataaggctgactaaaacactatataaccttctacttgatcacaatactccgtatacctatcatcatatatttaatcaagacgatatcctttaaaacttattcagtactataatcactctcgtttcaaattaataagatgtgcatgattgccctaatatatgaagaggtatgatacaaccctaacagtgatcaaagaaaatcataatctcgtatcgctcgtaatataacctgccaagcatactccctagaagcgttgaatcttgtacacaaataatgttttactctacaggaggtagcaacgatccatcccatcaaaaaataagtatttcatgacttactaatgatctcttaaaatattaagaaaaagcggccgcattaattaa

SEQ ID NO: 1047 - DNA, 1405 bp, Filovirus
ggtaccgcgatcgcgatgaagattaaaaccttcatcatccttacgtcaattgaattctctagcactcgaagcttattgtcttcaatgtaaaagaaaagctggtctaacaagatgacaactagaacaaagggcaggggccatactgcggccacgactcaaaacgacagaatgccaggccctgagctttcgggctggatctctgagcagctaatgaccggcaaaataccgctaaccgacatcttctgtgatattgagaacaatccaggattatgctacgcatcccaaatgcaacaaacgaagccaaacccgaagacgcgcaacagtcaaacccaaacggacccaatttgcaatcatagttttgaggaggtagtacaaacattggcttcattggctacagctgtgcgtcggcaaaccatcgcatcagaatcattagaacaacgcattacgagtcttgagaatggtctaaagccagtttatgatatggcaaaaacaatatcatccctgaatcgcagctgtgctgagatggttgcaaaatatgatcttctggtgatgacaaccggtcgggcaacagcaaccgctgcggcaactgaggcttattgggccgaacatggtcaaccaccaccaggcccatcattgtacgaggatggtgcgattcggggtaaattgaaagatccgaacgggaccgtccctcaaagtgttagggaggcattcaacaatctaaacagtaccacttcactaactgaggaaaatttcgggcgaccttacatttcggcaaaggatttgagaaacattatgtatgatcacttgcctggttttggaactgctttccaccaattagtacaagtgatttgtaaattgggaaaagatagcaactcattggacatcattcatgctgagttccaggccagcctggctgaaggagactctcctcaatgtgccctaattcaaattacaaaaagagttccaatcttccaagatgctgctccacctgtcatccacatccgctctcgaggtgacattccccgagcttgccagaaaagcttgcgtccagtcccaccatcgcccaagattgatcgaggttgggtatgtgtttttcagcttcaagatggtaaaacacttggactcaaaatttgagccaatgtaagctcattttgcgatgggcgaataatagcagaggcttcaactgctgaactatagggtacgttacattaatgatacacttgtgagtatcagccctggataatataagtcaatcctaatcaattgataatattgttcatatctcgctagcagcttaaaatataaatgtaataggagctatatctctgacagtattataatcaattgttattaagtaacccaaaccaaaagtgatgaagattaagaaaaagcggccgcagagctc

SEQ ID NO: 1048 - DNA, 1531 bp, Filovirus
ggtacctcgaggatgaagattaagaaaaacctacctcggctgagagagtgttttttcattaaccttcatcttgtaaacgttgagcaaaattgttaaaaatatgaggcgggttatattgcctactgctcctcctgaatatatggaggccatataccctgtcaggtcaaattcaacaattgctagaggtggcaacagcaatacaggcttcctgacaccggagtcagtcaatggggacactccatcgaatccactcaggccaattgccgatgacaccatcgaccatgccagccacacaccaggcagtgtgtcatcagcattcatccttgaagctatggtgaatgtcatatcgggccccaaagtgctaatgaagcaaatccctatttggttgcctctaggtgtcgctgatcaaaagacctacagctttgactcaactacggccgcaattatgctcgcatcttatacgatcacccatttcggcaaggcaaccaaccccctcgttagagtgaatcgactgggtcctggaatcccggatcatcccctcaggctcctgcgaattggaaaccaggctttcctccaggagttcgttcttccgccagtccaactaccccagtatttcacctttgatttgacagcactcaaactgatcacccaaccactgcctgctgcaacatggaccgatgacactccaacaggatcaaatggagcgttgcgtccaggaatttcatttcatccaaaacttcgccccattcttttacccaacaaaagtgggaagaaggggaacagtgccgatctaacatctccggagaaaatccaagcaataatgacttcactccaggactttaagatcgtgccaattgatccagccaagagtatcattgggatcgaggtgccagaaactctggtccacaagctgaccggtaagaaggtgacttctaaaaatggacaaccaatcatccctgttcttttgccaaagtacattgggttggacccggtggctccaggagacctcaccatggtaatcacacaggattgtgacacgtgtcattctcctgcaagtcttccagctgtgattgagaagtaattgcaataattgactcagatccagttttatagaatcttctcagggatagcaactcaatcgacttttaggaccgtccattagaggagacacttttaattgaaaaatgtactaatcgggtcaaggaccattgtcttttttctctcctaaatgtagaacttaacaaaagactcataatatacttgtttttaaaggattgattgatgaaagaacatgcataagcgatccatacttcgccctactataatcaatacggtgattcaaatgttaatctttctcattgcacatactttttgcccttatcctcaaattgcctgcatgcttacatctgaggatagccagtgtgacttggattggaaatgtggagaaaaaatcgggacccatttctaggttgttcacaatccaagtacagacattgcccttctaattaagaaaaaagcggccgcagagctc

SEQ ID NO: 1049 - DNA, 3055 bp, Filovirus
ggcgcgcctcgaggaggaagattaagaaaaactgcttattgggtctttccgtgttttagatgaagcagttgaaattcttcctcttgatattaaatggctacccaacatacacaatacccagacgctagttatcatcaccaattgtattggaccaatgtgacctagtcactagagcttgcgggttatattcatcatactcccttaatccgcaactacgcaactgtaaactcccgaaacatatctaccgtttgaaatacgtgtaactgttaccaagttcttgagtgatgtaccagtggcgacattgcccatagatttcatagtcccagttcttctcaaggcactgtcaggcaatggattctgtcctgttgagccgcggtgccaacagttctagatgaaatcattaagtacacaatgcaagatgctctcttcttgaaatattatctcaaaaatgtgggtgctcaagaagactgtgttgatgaacactttcaagagaaaatcttatcttcaattcagggcaatgatttttacatcaaatgtttttctggtatgatctggctattttaactcgaaggggtagattaaatcgaggaaactctagatcaacatggtttgttcatgatgatttaatagacatcttaggctatggggacttgttttttggaagatcccaatttcaatgttaccactgaacacacaaggaatcccccatgctgctatggactggtatcaggcatcagtattcaaagaagcggttcaagggcatacacacattgtttctgttttactgccgacgtcttgataatgtgcaaagatttaattacatgtcgattcaacacaactctaatctcaaaaatagcagagattgaggatccagtttgttctgattatcccaattttaagattgtgtctatgcttaccagagcggagattacttactctccatattagggtctgatgggtataaaattattaagttcctcgaaccattgtgcttggccaaaattcaattatgctcaaagtacactgaacgaaaagggcggttttaacacaaatgcatttagctgtaaatcacaccctagaagaaattacagaaatgcgtgcactaaagccttcacaggctcaaaagatccgtgaattccatagaacattgataaggctggagatgacgccacaacactttgtgagctattttccattcaaaaacactgggggcatcctgtgctacatagtgaaacagcaatccaaaaagttaaaaaacatgctacggtgctaaaagcattacgccctatagtgattttcgagacatctgtgtttttaaatatagtattgccaaacattattttgatagtcaaggatcttggtacagtgttacttcagaccgatgtttaacgccgggattgaattcttatatcaaaagaaatcaattccctccgttgcaatgattaaagaactactatgggaattttaccaccttgaccaccctccacttttctcaaccaaaattattagtgacttaagtatttttataaaagacagagctaccgcagtagaaaggacatgctgggatgagtattcgagcctaatgttctaggatataatccacctcacaaatttagtactaaacgtgtaccggaacaatttttagagcaagaaaacttttctattgagaatgttctttcatacgcccaagaacttaggttctactaccacaatatcggaacttttctttctcattgaaagagaaagagttgaatgtaggtagaaccttcggaaaattgccttatccgactcgcaatgttcaaacactttgtgaagctctgttagctgatgtcttgctaaagcatttcctagcaatatgatggtagttacggaacgtgagcaaaaagaaagcttattgcatcaagcatcatggcaccacacaagtgatgattttggtgaacatgccacagttagagggagtactttgtaactgatttagagaaatacaatcttgcatttagatatgagtttacagcaccttttatagaatattgcaaccgttgctatggtgttaagaatgtttttaattggatgcattatacaatcccacagtttatatgcatgtcagtgattattataatccaccacataacctcacactggagaatcgagacaacccccccgaagggcctagttcatacaggggtcatatgggagggattgaaggactgcaacaaaaactctgacaagtatttcatgtgctcaaatttctttagttgaaattaagactggttttaagttacgctcagctgtgatgggtgacaatcagtgcattactgttttatcagtcttccccttagagactgacgcagacggcaggaacagagcgccgaagacaatgcagcgagggtggccgccagcctagcaaaagttacaagtgcctgtggaatctttttaaaacctgatgagactttcgtacactcaggttttatctattttggaaaaaacaatatttgaatggggtccaattgcctcagtcccttaaaacggctacaagaatggcaccattgtctgatgcaatttttgatgatcttcaagggaccctggctagtataggcactgcttttgagcgatcaactccgaaactagacatatctttccttgcaggataaccgcagctttccatacgtttttttcggtgagaatcttgcaatatcatcatctcgggttcaataaaggttttgaccttggacagttaacactcggcaacctctggatttcggaacaatatcattggcactagcggtaccgcaggtgcttggagggttatccttcttgaatcctgagaaatgtttctaccggaatctaggagatccagttacctcaggcttattccagtaaaaacttatctccgaatagagacctattgagctccaccgcggtggcggccgctctagcccgggcggatcccccgggctgcaggaattcgatatcaagcttatcgataccgtcgacctcgagggggggcccgtaccttacatcgcgttaattaactagtggatcgatccccaattcg

SEQ ID NO: 1050 - DNA, 4076 bp, Filovirus
cgcgacgtaatacgactcactatagggcgaattgggcgcgccccgtctcagaatgattgagatggatgatttattcttacctttaattgcgaagaaccctgggaattgtagcgcaattgactttgtgtaaatcctagcggattaaatgtccctgggtcgcaagacttaacttcatttctgcgccagattgtacgcaggaccatcaccctaagtgcgaaaaacaaacttattaataccttatttcatgcgtcagctgactcgaagacgaaatggtttgtaaatggctattatcatcaactcctgttatgagtcgttttgcggccgatatcttttcacgcacgccgagcgggaagcgattgcaaattctaggatacctggaaggaacacgccattattagcctctaagatcatcaacaataatacagagacaccggttttggacagactgaggaaaataacattgcaaaggtggagcctatggtttagttatcttgatcattgtgataatatcctggcggagctttaacccaaataacttgcacagttgatttagcacagattctgagggaatattcatgggctcatattttagagggaagacctcttattggagccacactcccatgtatgattgagcaattcaaagtgtttggctgaaaccctacgaacaatgtccgcagtgttcaaatgcaaagcaaccaggtgggaaaccattcgtgtcagtggcagtcaagaaacatattgttagtgcatggccgaacgcatcccgaataagctggacttcggggatggaatcccatacattggatcaaggacagaagataagataggtcagcccgctattaagccgaggtgtccttccgcagccttaagagaggccattgaattggcgtcccgtttaacatgggtaactaaggcagttcgaacagtgacttgctaataaaaccatttttggaagcacgagtaaatttaagtgttcaagaaatacttcaaatgaccccttcacattactcaggaaatattgtgcatcggtataacgatcaaacagtcctcattctttcatggccaatcgtatgagtaattcagcaacgcgcttgatggtatctacaaacactttaggtgagttttcaggaggtggccagtctgcacgcgacagcaatattattttccagaatttataaattatgcagttgcactgttcgatattaaatttagaaacactgaggctacagatatccaatataatcgtgctcaccttcatctaactaagtgttgcacccgggaagtaccagctcagtatttaacaacacaaccacgctaaatctagatttaacaagataccgagaaaacgaattgatttatgacagtaatcctctaaaaggaggactcaattgcaacttatcgattgacagtccttttttccaaggtaaacggctgacattatagaagatgatcttattcgactgcctcacttatctggatgggagctagccaagaccatcatgcaatcaattatttcagatagcaacaattcatctacagacccaattagcagtggagaaacaagacattcactacccatttcttaacttatcccaagataggacttctgtacagttttggggcctttgtaagttattatcttggcaatacaattctttgcacgaaaaagatcggacttgacaattttttatattactaactactcaaattcataatctaccacatcgctcattgcgaatacttaagccaacattcaaacatgcaagcgttatgtcacggttaatgagtattgatcctcatttttctatttacataggcggtgctgcagtgacagaggactctcagatgcggccaggttatttttgagaacgtccatttcatcttttcttacatttgtaaaagaatggataattaatcgcggaacaattgtccctttatggatagtatatccgctagaggtcaaaacccaacacctgtgaataattttctctatcagatcgtagaactgctggtgcatgattcatcaagacaacaggcttttaaaactaccataagtgatcatgtacatcctcacgacaatcttgtttaccatgtaagagtacagccagcaatttcttccatgcatcattggcgtactggaggagcagacacagaaacagcaaccgaaaatacttggcaagagactcttcaactggatcaagcacaaacaacagtgatggtatattgagagaagtcaagaacaaaccaccagagatccacatgatggcactgaacggaatctagtcctacaaatgagccatgaaataaaaagaacgacaattccacaagaaaacacgcaccagggtccgtcgtccagtcctttctaagtgactctgcttgtggtacagcaaatccaaaactaaatttcgatcgatcgagacacaatgtgaaatttcaggatcataactcggcatccaagagggaaggtcatcaaataatctcaaccgtctagtcctacctttctttacattatctcaagggacacgccaattaacgtcatccaatgagtcacaaacccaagacgagatatcaaagtacttacggcaattgagatccgtcattgatactaccataattgtcgcttcaccggtatagtctcgtccatgcattacaaacttgatgaggtcctttgggaaatagagagtttcaagtcggctgtgacgctagcagagggagaaggtgctggtgccttactattgattcaaaatacggcgttaagaagttatttttcaacacgctagctactgagtccagtatagagtcagaaatagtatcaggaatgactactcctaggatgcttctacctgttatgtcaaaattccataatgaccaaattagattattcttaacaactcagcaagccaaataacagacataacaaatcctacttggtttaaagaccaaagagcaaggctacctaagcaagtcgaggttataaccatggatgcagagacaacagagaatataacagatcgaaattgtacgaagctgtatataaattgatcttacaccatattgatcctagcgtattgaaagcagtggtccttaaagtctttctaagtgatactgagggtatgttatggctaaatgataatttaccccgttttttgccactggttatttaattaagccaataacgtcaagtgctagatctagtgagtggtatctttgtctgacgaacttcttatcaactacacgtaagatgccacaccaaaaccatctcagttgtaacaggtaatacttacggcattgcaactgcaaattcaacgaagcccatactggctaagtcatttaactcagtatgctgactgtgagttacatttaagttatatccgccttggttttccatcattagagaaatactataccacaggtataacctcgtcgattcaaaaagaggtccactagtctctatcactcagcacttagcacatcttagagcagagattcgagaattaactaatgattataatcaacagcgacaaagtcgacccagacttatcattttattcgtactgcaaaaggacggataactaaactagtcaatgattatttaaaattctttcttattgtgcaagcattaaaacataatgggacatggcaagctgagtttaagaaattacagagttgattagtgtgtgcaataggttctaccatattagagattgcaattgtgaagaacgtttcttagttcaaaccttatatttacatagaatgcaggattctgaagttaagcttatcgaaaggctgacaggcttctgagtttatttccggatggtctctacaggtttgattgaattaccgtgcatagtatcctgatacttgcaaaggttggttattaacatacagattataaaaaagcggccgcagagctccagcggtggggccgccggcgtctagcccgggcggatccctgcaggaattcgatatcaagcttatcgataccgtcgacctcgagggcccatgcaggccggccaggtaccttagttaattaacagcttttgttccctttagtagggttaattgacgcgctc

SEQ ID NO: 1051 - DNA, 21 bp, Artificial Sequence
  Description of Artificial Sequence: Synthetic oligonucleotide
  modified_base (2)..(2): 2'-O-methylcytidine-5'-phosphate
  modified_base (3)..(3): 2'-O-methyluridine-5'-phosphate
  modified_base (9)..(9): 2'-O-methylcytidine-5'-phosphate
  modified_base (10)..(10): 2'-O-methyluridine-5'-phosphate
  modified_base (12)..(12): 2'-O-methylcytidine-5'-phosphate
  modified_base (13)..(13): 2'-O-methyluridine-5'-phosphate
  modified_base (15)..(15): 2'-O-methylcytidine-5'-phosphate
  modified_base (18)..(18): 2'-O-methyluridine-5'-phosphate
  modified_base (19)..(19): 2'-O-methylcytidine-5'-phosphate
  modified_base (21)..(21): 2'-deoxy-thymidine-5'-phosphate-phosphorothioate
gnngaaaanngnnanaanntt

SEQ ID NO: 1052 - DNA, 21 bp, Artificial Sequence
  Description of Artificial Sequence: Synthetic oligonucleotide
  modified_base (6)..(6): 2'-O-methyluridine-5'-phosphate
  modified_base (9)..(9): 2'-O-methylcytidine-5'-phosphate
  modified_base (16)..(16): 2'-O-methylcytidine-5'-phosphate
  modified_base (21)..(21): 2'-deoxy-thymidine-5'-phosphate-phosphorothioate
gauugnagnaguuuunagctt

SEQ ID NO: 1053 - DNA, 21 bp, Artificial Sequence
  Description of Artificial Sequence: Synthetic oligonucleotide
  modified_base (1)..(1): 2'-O-methylcytidine-5'-phosphate
  modified_base (2)..(2): 2'-O-methyluridine-5'-phosphate
  modified_base (8)..(8): 2'-O-methylcytidine-5'-phosphate
  modified_base (9)..(9): 2'-O-methyluridine-5'-phosphate
  modified_base (11)..(11): 2'-O-methylcytidine-5'-phosphate
  modified_base (12)..(12): 2'-O-methyluridine-5'-phosphate
  modified_base (14)..(14): 2'-O-methylcytidine-5'-phosphate
  modified_base (17)..(17): 2'-O-methyluridine-5'-phosphate
  modified_base (18)..(18): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
nngaaaanngnnanaannntt

SEQ ID NO: 1054 - DNA, 21 bp, Artificial Sequence
  Description of Artificial Sequence: Synthetic oligonucleotide
  modified_base (7)..(7): 2'-O-methyluridine-5'-phosphate
  modified_base (10)..(10): 2'-O-methylcytidine-5'-phosphate
  modified_base (17)..(17): 2'-O-methylcytidine-5'-phosphate
  modified_base (21)..(21): 2'-deoxy-thymidine-5'-phosphate-phosphorothioate
agauugnagnaguuuunagtt

SEQ ID NO: 1055 - DNA, 21 bp, Artificial Sequence
  Description of Artificial Sequence: Synthetic oligonucleotide
  modified_base (5)..(5): 2'-O-methylcytidine-5'-phosphate
  modified_base (6)..(6): 2'-O-methyluridine-5'-phosphate
  modified_base (8)..(8): 2'-O-methylcytidine-5'-phosphate
  modified_base (9)..(9): 2'-O-methyluridine-5'-phosphate
  modified_base (11)..(11): 2'-O-methylcytidine-5'-phosphate
  modified_base (14)..(14): 2'-O-methyluridine-5'-phosphate
  modified_base (15)..(15): 2'-O-methylcytidine-5'-phosphate
  modified_base (16)..(17): 2'-O-methyluridine-5'-phosphate
  modified_base (21)..(21): 2'-deoxy-thymidine-5'-phosphate-phosphorothioate
aaaanngnnanaannnngatt

SEQ ID NO: 1056 - DNA, 21 bp, Artificial Sequence
  Description of Artificial Sequence: Synthetic oligonucleotide
  modified_base (2)..(2): 2'-O-methylcytidine-5'-phosphate
  modified_base (10)..(10): 2'-O-methyluridine-5'-phosphate
  modified_base (13)..(13): 2'-O-methylcytidine-5'-phosphate
  modified_base (21)..(21): 2'-deoxy-thymidine-5'-phosphate-phosphorothioate
unaagauugnagnaguuuutt

SEQ ID NO: 1057 - DNA, 21 bp, Artificial Sequence
  Description of Artificial Sequence: Synthetic oligonucleotide
  modified_base (2)..(2): 2'-O-methylcytidine-5'-phosphate
  modified_base (3)..(3): 2'-O-methyluridine-5'-phosphate
  modified_base (5)..(5): 2'-O-methylcytidine-5'-phosphate
  modified_base (6)..(6): 2'-O-methyluridine-5'-phosphate
  modified_base (8)..(8): 2'-O-methylcytidine-5'-phosphate
  modified_base (11)..(11): 2'-O-methyluridine-5'-phosphate
  modified_base (12)..(12): 2'-O-methylcytidine-5'-phosphate
  modified_base (13)..(14): 2'-O-methyluridine-5'-phosphate
  modified_base (19)..(19): 2'-O-methyluridine-5'-phosphate
  modified_base (21)..(21): 2'-deoxy-thymidine-5'-phosphate-phosphorothioate
anngnnanaannnngaaantt

SEQ ID NO: 1058 - DNA, 21 bp, Artificial Sequence
  Description of Artificial Sequence: Synthetic oligonucleotide
  modified_base (5)..(5): 2'-O-methylcytidine-5'-phosphate
  modified_base (13)..(13): 2'-O-methyluridine-5'-phosphate
  modified_base (16)..(16): 2'-O-methylcytidine-5'-phosphate
  modified_base (21)..(21): 2'-deoxy-thymidine-5'-phosphate-phosphorothioate
auuunaagauugnagnagutt

SEQ ID NO: 1059 - DNA, 21 bp, Artificial Sequence
  Description of Artificial Sequence: Synthetic oligonucleotide
  modified_base (3)..(3): 2'-O-methylcytidine-5'-phosphate
  modified_base (7)..(7): 2'-O-methyluridine-5'-phosphate
  modified_base (8)..(9): 2'-O-methylcytidine-5'-phosphate
  modified_base (12)..(12): 2'-O-methylcytidine-5'-phosphate
  modified_base (15)..(15): 2'-O-methylcytidine-5'-phosphate
  modified_base (16)..(16): 2'-O-methyluridine-5'-phosphate
  modified_base (19)..(19): 2'-O-methyluridine-5'-phosphate
  modified_base (21)..(21): 2'-deoxy-thymidine-5'-phosphate-phosphorothioate
agnaaannnaanggnngantt

SEQ ID NO: 1060 - DNA, 21 bp, Artificial Sequence
  Description of Artificial Sequence: Synthetic oligonucleotide
  modified_base (3)..(3): 2'-O-methylcytidine-5'-phosphate
  modified_base (21)..(21): 2'-deoxy-thymidine-5'-phosphate-phosphorothioate
aunagccguuggauuugcutt

SEQ ID NO: 1061 - DNA, 21 bp, Artificial Sequence
  Description of Artificial Sequence: Synthetic oligonucleotide
  modified_base (1)..(1): 2'-O-methylcytidine-5'-phosphate
  modified_base (5)..(5): 2'-O-methyluridine-5'-phosphate
  modified_base (6)..(7): 2'-O-methylcytidine-5'-phosphate
  modified_base (10)..(10): 2'-O-methylcytidine-5'-phosphate
  modified_base (13)..(13): 2'-O-methylcytidine-5'-phosphate
  modified_base (14)..(14): 2'-O-methyluridine-5'-phosphate
  modified_base (17)..(17): 2'-O-methyluridine-5'-phosphate
  modified_base (21)..(21): 2'-deoxy-thymidine-5'-phosphate-phosphorothioate
naaannnaanggnngangatt

SEQ ID NO: 1062 - DNA, 21 bp, Artificial Sequence
  Description of Artificial Sequence: Synthetic oligonucleotide
  modified_base (2)..(2): 2'-O-methylcytidine-5'-phosphate
  modified_base (5)..(5): 2'-O-methylcytidine-5'-phosphate
  modified_base (21)..(21): 2'-deoxy-thymidine-5'-phosphate-phosphorothioate
unaunagccguuggauuugtt

SEQ ID NO: 1063 - DNA, 21 bp, Artificial Sequence
  Description of Artificial Sequence: Synthetic oligonucleotide
  modified_base (2)..(2): 2'-O-methyluridine-5'-phosphate
  modified_base (4)..(4): 2'-O-methylcytidine-5'-phosphate
  modified_base (6)..(6): 2'-O-methyluridine-5'-phosphate
  modified_base (8)..(8): 2'-O-methyluridine-5'-phosphate
  modified_base (9)..(9): 2'-O-methylcytidine-5'-phosphate
  modified_base (12)..(12): 2'-O-methyluridine-5'-phosphate
  modified_base (15)..(16): 2'-O-methyluridine-5'-phosphate
  modified_base (18)..(19): 2'-O-methyluridine-5'-phosphate
  modified_base (21)..(21): 2'-deoxy-thymidine-5'-phosphate-phosphorothioate
angnangnnagngannanntt

SEQ ID NO: 1064 - DNA, 21 bp, Artificial Sequence
  Description of Artificial Sequence: Synthetic oligonucleotide
  modified_base (3)..(3): 2'-O-methyluridine-5'-phosphate
  modified_base (7)..(7): 2'-O-methylcytidine-5'-phosphate
  modified_base (13)..(13): 2'-O-methylcytidine-5'-phosphate
  modified_base (17)..(17): 2'-O-methylcytidine-5'-phosphate
  modified_base (21)..(21): 2'-deoxy-thymidine-5'-phosphate-phosphorothioate
aanaaunacuganaugnautt

SEQ ID NO: 1065 - DNA, 21 bp, Artificial Sequence
  Description of Artificial Sequence: Synthetic oligonucleotide
  modified_base (1)..(1): 2'-O-methyluridine-5'-phosphate
  modified_base (3)..(3): 2'-O-methylcytidine-5'-phosphate
  modified_base (5)..(5): 2'-O-methyluridine-5'-phosphate
  modified_base (7)..(7): 2'-O-methyluridine-5'-phosphate
  modified_base (8)..(8): 2'-O-methylcytidine-5'-phosphate
  modified_base (11)..(11): 2'-O-methyluridine-5'-phosphate
  modified_base (14)..(15): 2'-O-methyluridine-5'-phosphate
  modified_base (17)..(18): 2'-O-methyluridine-5'-phosphate
  modified_base (21)..(21): 2'-deoxy-thymidine-5'-phosphate-phosphorothioate
ngnangnnagngannannatt

SEQ ID NO: 1066 - DNA, 21 bp, Artificial Sequence
  Description of Artificial Sequence: Synthetic oligonucleotide
  modified_base (1)..(1): 2'-O-methyluridine-5'-phosphate
  modified_base (4)..(4): 2'-O-methyluridine-5'-phosphate
  modified_base (8)..(8): 2'-O-methylcytidine-5'-phosphate
  modified_base (14)..(14): 2'-O-methylcytidine-5'-phosphate
  modified_base (18)..(18): 2'-O-methylcytidine-5'-phosphate
  modified_base (21)..(21): 2'-deoxy-thymidine-5'-phosphate-phosphorothioate
naanaaunacuganaugnatt

SEQ ID NO: 1067 - DNA, 21 bp, Artificial Sequence
  Description of Artificial Sequence: Synthetic oligonucleotide
  modified_base (2)..(2): 2'-O-methylcytidine-5'-phosphate
  modified_base (4)..(4): 2'-O-methyluridine-5'-phosphate
  modified_base (6)..(6): 2'-O-methyluridine-5'-phosphate
  modified_base (7)..(7): 2'-O-methylcytidine-5'-phosphate
  modified_base (10)..(10): 2'-O-methyluridine-5'-phosphate
  modified_base (13)..(14): 2'-O-methyluridine-5'-phosphate
  modified_base (16)..(17): 2'-O-methyluridine-5'-phosphate
  modified_base (19)..(19): 2'-O-methyluridine-5'-phosphate
  modified_base (21)..(21): 2'-deoxy-thymidine-5'-phosphate-phosphorothioate
gnangnnagngannannantt

SEQ ID NO: 1068 - DNA, 21 bp, Artificial Sequence
  Description of Artificial Sequence: Synthetic oligonucleotide
  modified_base (2)..(2): 2'-O-methyluridine-5'-phosphate
  modified_base (5)..(5): 2'-O-methyluridine-5'-phosphate
  modified_base (9)..(9): 2'-O-methylcytidine-5'-phosphate
  modified_base (15)..(15): 2'-O-methylcytidine-5'-phosphate
  modified_base (21)..(21): 2'-deoxy-thymidine-5'-phosphate-phosphorothioate
anaanaaunacuganaugctt

SEQ ID NO: 1069 - DNA, 21 bp, Artificial Sequence
  Description of Artificial Sequence: Synthetic oligonucleotide
  modified_base (1)..(1): 2'-O-methylcytidine-5'-phosphate
  modified_base (3)..(3): 2'-O-methyluridine-5'-phosphate
  modified_base (5)..(5): 2'-O-methyluridine-5'-phosphate
  modified_base (6)..(6): 2'-O-methylcytidine-5'-phosphate
  modified_base (9)..(9): 2'-O-methyluridine-5'-phosphate
  modified_base (12)..(13): 2'-O-methyluridine-5'-phosphate
  modified_base (15)..(16): 2'-O-methyluridine-5'-phosphate
  modified_base (18)..(18): 2'-O-methyluridine-5'-phosphate
  modified_base (21)..(21): 2'-deoxy-thymidine-5'-phosphate-phosphorothioate
nangnnagngannannanatt

SEQ ID NO: 1070 - DNA, 21 bp, Artificial Sequence
  Description of Artificial Sequence: Synthetic oligonucleotide
  modified_base (1)..(1): 2'-O-methyluridine-5'-phosphate
  modified_base (3)..(3): 2'-O-methyluridine-5'-phosphate
  modified_base (6)..(6): 2'-O-methyluridine-5'-phosphate
  modified_base (10)..(10): 2'-O-methylcytidine-5'-phosphate
  modified_base (16)..(16): 2'-O-methylcytidine-5'-phosphate
  modified_base (21)..(21): 2'-deoxy-thymidine-5'-phosphate-phosphorothioate
nanaanaaunacuganaugtt

SEQ ID NO: 1071 - DNA, 21 bp, Artificial Sequence
  Description of Artificial Sequence: Synthetic oligonucleotide
  modified_base (2)..(2): 2'-O-methyluridine-5'-phosphate
  modified_base (4)..(4): 2'-O-methyluridine-5'-phosphate
  modified_base (5)..(5): 2'-O-methylcytidine-5'-phosphate
  modified_base (8)..(8): 2'-O-methyluridine-5'-phosphate
  modified_base (11)..(12): 2'-O-methyluridine-5'-phosphate
  modified_base (14)..(15): 2'-O-methyluridine-5'-phosphate
  modified_base (17)..(17): 2'-O-methyluridine-5'-phosphate
  modified_base (21)..(21): 2'-deoxy-thymidine-5'-phosphate-phosphorothioate
angnnagngannannanaatt

SEQ ID NO: 1072 - DNA, 21 bp, Artificial Sequence
  Description of Artificial Sequence: Synthetic oligonucleotide
  modified_base (2)..(2): 2'-O-methyluridine-5'-phosphate
  modified_base (4)..(4): 2'-O-methyluridine-5'-phosphate
  modified_base (7)..(7): 2'-O-methyluridine-5'-phosphate
  modified_base (11)..(11): 2'-O-methylcytidine-5'-phosphate
  modified_base (17)..(17): 2'-O-methylcytidine-5'-phosphate
  modified_base (21)..(21): 2'-deoxy-thymidine-5'-phosphate-phosphorothioate
unanaanaaunacuganautt

SEQ ID NO: 1073 - RNA, 25 nt, Artificial Sequence
  Description of Artificial Sequence: Synthetic oligonucleotide
ccaucucugagacacgacauaucuu

SEQ ID NO: 1074 - RNA, 25 nt, Artificial Sequence
  Description of Artificial Sequence: Synthetic oligonucleotide
aagauaugucgugucucagagaugg

SEQ ID NO: 1075 - RNA, 25 nt, Artificial Sequence
  Description of Artificial Sequence: Synthetic oligonucleotide
gguucaaaggcaaauucaaguacau

SEQ ID NO: 1076 - RNA, 25 nt, Artificial Sequence
  Description of Artificial Sequence: Synthetic oligonucleotide
auguacuugaauuugccuuugaacc

SEQ ID NO: 1077 - RNA, 25 nt, Artificial Sequence
  Description of Artificial Sequence: Synthetic oligonucleotide
cccaaaugcaacaaaccaagccaaa

SEQ ID NO: 1078 - RNA, 25 nt, Artificial Sequence
  Description of Artificial Sequence: Synthetic oligonucleotide
uuuggcuugguuuguugcauuuggg

SEQ ID NO: 1079 - DNA, 21 bp, Artificial Sequence
  Description of Artificial Sequence: Synthetic oligonucleotide
  modified_base (21)..(21): 2'-deoxy-thymidine-5'-phosphate-phosphorothioate
cuuacgcugaguacuucgatt

SEQ ID NO: 1080 - DNA, 21 bp, Artificial Sequence
  Description of Artificial Sequence: Synthetic oligonucleotide
  modified_base (21)..(21): 2'-deoxy-thymidine-5'-phosphate-phosphorothioate
ucgaaguacucagcguaagtt

SEQ ID NO: 1081 - RNA, 21 nt, Artificial Sequence
  Description of Artificial Sequence: Synthetic oligonucleotide
  modified_base (2)..(2): 2'-O-methylcytidine-5'-phosphate
  modified_base (4)..(4): 2'-O-methylcytidine-5'-phosphate
  modified_base (6)..(6): 2'-O-methyluridine-5'-phosphate
  modified_base (11)..(11): 2'-O-methylcytidine-5'-phosphate
  modified_base (14)..(14): 2'-O-methylcytidine-5'-phosphate
  modified_base (20)..(20): 2'-O-methyluridine-5'-phosphate
  modified_base (21..(21): 2'-deoxy-uridine-5'-phosphate-phosphorothioate
cnanangaagnagnacgacnu

SEQ ID NO: 1082 - RNA, 23 nt, Artificial Sequence
  Description of Artificial Sequence: Synthetic oligonucleotide
  modified_base (21)..(21): 2'-O-methylguanosine-5'-phosphate
  modified_base (22)..(22): 2'-deoxy-2'-O-methyluridine-5'-phosphate-phosphorothioate
  modified_base (23)..(23): 2'-deoxy-cytidine-5'-phosphate-phosphorothioate
aagucgugcugcuucaugugnnc

SEQ ID NO: 1083 - DNA, 21 bp, Artificial Sequence
  Description of Artificial Sequence: Synthetic oligonucleotide
guacgaagcuguauauaaatt

SEQ ID NO: 1084 - DNA, 21 bp, Artificial Sequence
  Description of Artificial Sequence: Synthetic oligonucleotide
uuuauauacagcuucguactt

SEQ ID NO: 1085 - DNA, 21 bp, Artificial Sequence
  Description of Artificial Sequence: Synthetic oligonucleotide
  modified_base (3)..(4): 2'-O-methyluridine-5'-phosphate
  modified_base (6)..(6): 2'-O-methylcytidine-5'-phosphate
  modified_base (7)..(7): 2'-O-methyluridine-5'-phosphate
  modified_base (8)..(8): 2'-O-methylcytidine-5'-phosphate
  modified_base (15)..(15): 2'-O-methylcytidine-5'-phosphate
  modified_base (18)..(18): 2'-O-methylcytidine-5'-phosphate
  modified_base (21)..(21): 2'-deoxy-thymidine-5'-phosphate-phosphorothioate
agnnannnggaaaanggnatt

SEQ ID NO: 1086 - DNA, 21 bp, Artificial Sequence
  Description of Artificial Sequence: Synthetic oligonucleotide
  modified_base (15)..(15): 2'-O-methyluridine-5'-phosphate
  modified_base (21)..(21): 2'-deoxy-thymidine-5'-phosphate-phosphorothioate
ugccguuuuccgagnaacutt

SEQ ID NO: 1087 - DNA, 21 bp, Artificial Sequence
  Description of Artificial Sequence: Synthetic oligonucleotide
  modified_base (3)..(3): 2'-O-methylcytidine-5'-phosphate
  modified_base (5)..(5): 2'-O-methylcytidine-5'-phosphate
  modified_base (6)..(6): 2'-O-methyluridine-5'-phosphate
  modified_base (8)..(8): 2'-O-methyluridine-5'-phosphate
  modified_base (11)..(11): 2'-O-methyluridine-5'-phosphate
  modified_base (14)..(14): 2'-O-methylcytidine-5'-phosphate
  modified_base (15)..(15): 2'-O-methyluridine-5'-phosphate
  modified_base (16)..(16): 2'-O-methylcytidine-5'-phosphate
  modified_base (17)..(17): 2'-O-methyluridine-5'-phosphate
  modified_base (21)..(21): 2'-deoxy-thymidine-5'-phosphate-phosphorothioate
aangnnanggnaannnnaatt

SEQ ID NO: 1088 - DNA, 21 bp, Artificial Sequence
  Description of Artificial Sequence: Synthetic oligonucleotide
  modified_base (2)..(2): 2'-O-methyluridine-5'-phosphate
  modified_base (8)..(8): 2'-O-methyluridine-5'-phosphate
  modified_base (11)..(11): 2'-O-methylcytidine-5'-phosphate
  modified_base (13)..(13): 2'-O-methyluridine-5'-phosphate
  modified_base (21)..(21): 2'-deoxy-thymidine-5'-phosphate-phosphorothioate
unagagunacnanagcguutt

SEQ ID NO: 1089 - DNA, 21 bp, Artificial Sequence
  Description of Artificial Sequence: Synthetic oligonucleotide
  modified_base (1)..(2): 2'-O-methyluridine-5'-phosphate
  modified_base (4)..(4): 2'-O-methylcytidine-5'-phosphate
  modified_base (5)..(5): 2'-O-methyluridine-5'-phosphate
  modified_base (6)..(6): 2'-O-methylcytidine-5'-phosphate
  modified_base (13)..(13): 2'-O-methylcytidine-5'-phosphate
  modified_base (16)..(16): 2'-O-methylcytidine-5'-phosphate
  modified_base (18)..(18): 2'-O-methyluridine-5'-phosphate
  modified_base (21)..(21): 2'-deoxy-thymidine-5'-phosphate-phosphorothioate
nnannnggaaaanggnangtt

SEQ ID NO: 1090 - DNA, 21 bp, Artificial Sequence
  Description of Artificial Sequence: Synthetic oligonucleotide
  modified_base (1)..(1): 2'-O-methylcytidine-5'-phosphate
  modified_base (17)..(17): 2'-O-methyluridine-5'-phosphate
  modified_base (21)..(21): 2'-deoxy-thymidine-5'-phosphate-phosphorothioate
naugccguuuuccgagnaatt

SEQ ID NO: 1091 - DNA, 21 bp, Artificial Sequence
  Description of Artificial Sequence: Synthetic oligonucleotide
  modified_base (4)..(4): 2'-O-methylcytidine-5'-phosphate
  modified_base (8)..(8): 2'-O-methylcytidine-5'-phosphate
  modified_base (10)..(10): 2'-O-methylcytidine-5'-phosphate
  modified_base (11)..(11): 2'-O-methyluridine-5'-phosphate
  modified_base (13)..(13): 2'-O-methyluridine-5'-phosphate
  modified_base (16)..(16): 2'-O-methyluridine-5'-phosphate
  modified_base (19)..(19): 2'-O-methylcytidine-5'-phosphate
  modified_base (21)..(21): 2'-deoxy-thymidine-5'-phosphate-phosphorothioate
aaanaaangnnanggnaantt

SEQ ID NO: 1092 - DNA, 21 bp, Artificial Sequence
  Description of Artificial Sequence: Synthetic oligonucleotide
  modified_base (3)..(3): 2'-O-methyluridine-5'-phosphate
  modified_base (6)..(6): 2'-O-methylcytidine-5'-phosphate
  modified_base (8)..(8): 2'-O-methyluridine-5'-phosphate
  modified_base (21)..(21): 2'-deoxy-thymidine-5'-phosphate-phosphorothioate
gunacnanagcguuuguuutt

SEQ ID NO: 1093 - DNA, 21 bp, Artificial Sequence
  Description of Artificial Sequence: Synthetic oligonucleotide
  modified_base (5)..(5): 2'-O-methyluridine-5'-phosphate
  modified_base (6)..(6): 2'-deoxy-thymidine-5'-phosphate-phosphorothioate
  modified_base (7)..(7): 2'-O-methyluridine-5'-phosphate
  modified_base (8)..(8): 2'-O-methylcytidine-5'-phosphate
  modified_base (10)..(10): 2'-O-methylcytidine-5'-phosphate
  modified_base (14)..(14): 2'-O-methylcytidine-5'-phosphate
  modified_base (15)..(16): 2'-O-methyluridine-5'-phosphate
  modified_base (19)..(19): 2'-O-methylcytidine-5'-phosphate
  modified_base (21)..(21): 2'-deoxy-thymidine-5'-phosphate-phosphorothioate
agagnnnngngaannngantt

SEQ ID NO: 1094 - DNA, 21 bp, Artificial Sequence
  Description of Artificial Sequence: Synthetic oligonucleotide
  modified_base (3)..(3): 2'-O-methylcytidine-5'-phosphate
  modified_base (21)..(21): 2'-deoxy-thymidine-5'-phosphate-phosphorothioate
gunaaguucgcgagacucutt

SEQ ID NO: 1095 - DNA, 21 bp, Artificial Sequence
  Description of Artificial Sequence: Synthetic oligonucleotide
  modified_base (4)..(4): 2'-O-methyluridine-5'-phosphate
  modified_base (5)..(5): 2'-O-methylcytidine-5'-phosphate
  modified_base (6)..(6): 2'-O-methyluridine-5'-phosphate
  modified_base (7)..(7): 2'-O-methylcytidine-5'-phosphate
  modified_base (9)..(9): 2'-O-methylcytidine-5'-phosphate
  modified_base (13)..(13): 2'-O-methylcytidine-5'-phosphate
  modified_base (14)..(15): 2'-O-methyluridine-5'-phosphate
  modified_base (18)..(19): 2'-O-methylcytidine-5'-phosphate
  modified_base (21)..(21): 2'-deoxy-thymidine-5'-phosphate-phosphorothioate
gagnnnngngaannnganntt

SEQ ID NO: 1096 - DNA, 21 bp, Artificial Sequence
  Description of Artificial Sequence: Synthetic oligonucleotide
  modified_base (4)..(4): 2'-O-methylcytidine-5'-phosphate
  modified_base (21)..(21): 2'-deoxy-thymidine-5'-phosphate-phosphorothioate
ggunaaguucgcgagacuctt

SEQ ID NO: 1097 - DNA, 21 bp, Artificial Sequence
  Description of Artificial Sequence: Synthetic oligonucleotide
  modified_base (2)..(2): 2'-O-methylcytidine-5'-phosphate
  modified_base (6)..(6): 2'-O-methylcytidine-5'-phosphate
  modified_base (8)..(8): 2'-O-methylcytidine-5'-phosphate
  modified_base (9)..(9): 2'-O-methyluridine-5'-phosphate
  modified_base (11)..(11): 2'-O-methyluridine-5'-phosphate
  modified_base (14)..(14): 2'-O-methyluridine-5'-phosphate
  modified_base (17)..(17): 2'-O-methylcytidine-5'-phosphate
  modified_base (18)..(18): 2'-O-methyluridine-5'-phosphate
  modified_base (19)..(19): 2'-O-methylcytidine-5'-phosphate
  modified_base (21)..(21): 2'-deoxy-thymidine-5'-phosphate-phosphorothioate
anaaangnnanggnaannntt

SEQ ID NO: 1098 - DNA, 21 bp, Artificial Sequence
  Description of Artificial Sequence: Synthetic oligonucleotide
  modified_base (5)..(5): 2'-O-methyluridine-5'-phosphate
  modified_base (8)..(8): 2'-O-methylcytidine-5'-phosphate
  modified_base (10)..(10): 2'-O-methyluridine-5'-phosphate
  modified_base (21)..(21): 2'-deoxy-thymidine-5'-phosphate-phosphorothioate
gagunacnanagcguuugutt

SEQ ID NO: 1099 - DNA, 21 bp, Artificial Sequence
  Description of Artificial Sequence: Synthetic oligonucleotide
  modified_base (1)..(1): 2'-O-methylcytidine-5'-phosphate
  modified_base (5)..(5): 2'-O-methylcytidine-5'-phosphate
  modified_base (7)..(7): 2'-O-methylcytidine-5'-phosphate
  modified_base (8)..(8): 2'-O-methyluridine-5'-phosphate
  modified_base (10)..(10): 2'-O-methyluridine-5'-phosphate
  modified_base (13)..(13): 2'-O-methyluridine-5'-phosphate
  modified_base (16)..(16): 2'-O-methylcytidine-5'-phosphate
  modified_base (17)..(17): 2'-O-methyluridine-5'-phosphate
  modified_base (18)..(18): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
naaangnnanggnaannnntt

SEQ ID NO: 1100 - DNA, 21 bp, Artificial Sequence
  Description of Artificial Sequence: Synthetic oligonucleotide
  modified_base (6)..(6): 2'-O-methyluridine-5'-phosphate
  modified_base (9)..(9): 2'-O-methylcytidine-5'-phosphate
  modified_base (11)..(11): 2'-O-methyluridine-5'-phosphate
  modified_base (21)..(21): 2'-deoxy-thymidine-5'-phosphate-phosphorothioate
agagunacnanagcguuugtt

SEQ ID NO: 1101 - DNA, 21 bp, Artificial Sequence
  Description of Artificial Sequence: Synthetic oligonucleotide
  modified_base (1)..(1): 2'-O-methylcytidine-5'-phosphate
  modified_base (3)..(4): 2'-O-methylcytidine-5'-phosphate
  modified_base (7)..(7): 2'-O-methylcytidine-5'-phosphate
  modified_base (8)..(8): 2'-O-methyluridine-5'-phosphate
  modified_base (9)..(11): 2'-O-methylcytidine-5'-phosphate
  modified_base (13)..(13): 2'-O-methyluridine-5'-phosphate
  modified_base (15)..(15): 2'-O-methyluridine-5'-phosphate
  modified_base (17)..(17): 2'-O-methylcytidine-5'-phosphate
  modified_base (21)..(21): 2'-deoxy-thymidine-5'-phosphate-phosphorothioate
nannggnnnnngnananagtt

SEQ ID NO: 1102 - DNA, 21 bp, Artificial Sequence
  Description of Artificial Sequence: Synthetic oligonucleotide
  modified_base (4)..(4): 2'-O-methyluridine-5'-phosphate
  modified_base (6)..(6): 2'-O-methyluridine-5'-phosphate
  modified_base (21)..(21): 2'-deoxy-thymidine-5'-phosphate-phosphorothioate
cugnanacgggagccggugtt

SEQ ID NO: 1103 - DNA, 21 bp, Artificial Sequence
  Description of Artificial Sequence: Synthetic oligonucleotide
  modified_base (1)..(1): 2'-O-methylcytidine-5'-phosphate
  modified_base (2)..(2): 2'-O-methyluridine-5'-phosphate
  modified_base (5)..(5): 2'-O-methylcytidine-5'-phosphate
  modified_base (6)..(6): 2'-O-methyluridine-5'-phosphate
  modified_base (9)..(9): 2'-O-methylcytidine-5'-phosphate
  modified_base (12)..(14): 2'-O-methyluridine-5'-phosphate
  modified_base (16)..(16): 2'-O-methyluridine-5'-phosphate
  modified_base (17)..(17): 2'-O-methylcytidine-5'-phosphate
  modified_base (18)..(18): 2'-O-methyluridine-5'-phosphate
  modified_base (21)..(21): 2'-deoxy-thymidine-5'-phosphate-phosphorothioate
nnaannagngannnannnatt

SEQ ID NO: 1104 - DNA, 21 bp, Artificial Sequence
  Description of Artificial Sequence: Synthetic oligonucleotide
  modified_base (1)..(1): 2'-O-methyluridine-5'-phosphate
  modified_base (5)..(5): 2'-O-methyluridine-5'-phosphate
  modified_base (13)..(13): 2'-O-methyluridine-5'-phosphate
  modified_base (17)..(17): 2'-O-methyluridine-5'-phosphate
  modified_base (21)..(21): 2'-deoxy-thymidine-5'-phosphate-phosphorothioate
naganaaaucgcnagunagtt

SEQ ID NO: 1105 - DNA, 21 bp, Artificial Sequence
  Description of Artificial Sequence: Synthetic oligonucleotide
  modified_base (2)..(2): 2'-O-methylcytidine-5'-phosphate
  modified_base (3)..(3): 2'-O-methyluridine-5'-phosphate
  modified_base (7)..(7): 2'-O-methylcytidine-5'-phosphate
  modified_base (8)..(8): 2'-O-methyluridine-5'-phosphate
  modified_base (10)..(10): 2'-O-methyluridine-5'-phosphate
  modified_base (15)..(15): 2'-O-methyluridine-5'-phosphate
  modified_base (17)..(17): 2'-O-methylcytidine-5'-phosphate
  modified_base (19)..(19): 2'-O-methyluridine-5'-phosphate
  modified_base (21)..(21): 2'-deoxy-thymidine-5'-phosphate-phosphorothioate
gnngaannanagggnangntt

SEQ ID NO: 1106 - DNA, 21 bp, Artificial Sequence
  Description of Artificial Sequence: Synthetic oligonucleotide
  modified_base (4)..(4): 2'-O-methyluridine-5'-phosphate
  modified_base (9)..(9): 2'-O-methyluridine-5'-phosphate
  modified_base (11)..(11): 2'-O-methyluridine-5'-phosphate
  modified_base (16)..(16): 2'-O-methylcytidine-5'-phosphate
  modified_base (21)..(21): 2'-deoxy-thymidine-5'-phosphate-phosphorothioate
acgnacccnanaguunagctt

SEQ ID NO: 1107 - DNA, 21 bp, Artificial Sequence
  Description of Artificial Sequence: Synthetic oligonucleotide
  modified_base (3)..(3): 2'-O-methylcytidine-5'-phosphate
  modified_base (4)..(4): 2'-O-methyluridine-5'-phosphate
  modified_base (6)..(6): 2'-O-methyluridine-5'-phosphate
  modified_base (11)..(11): 2'-O-methyluridine-5'-phosphate
  modified_base (13)..(13): 2'-O-methylcytidine-5'-phosphate
  modified_base (15)..(16): 2'-O-methyluridine-5'-phosphate
  modified_base (18)..(18): 2'-O-methylcytidine-5'-phosphate
  modified_base (21)..(21): 2'-deoxy-thymidine-5'-phosphate-phosphorothioate
aannanagggnangnnanatt

SEQ ID NO: 1108 - DNA, 21 bp, Artificial Sequence
  Description of Artificial Sequence: Synthetic oligonucleotide
  modified_base (3)..(3): 2'-O-methyluridine-5'-phosphate
  modified_base (8)..(8): 2'-O-methyluridine-5'-phosphate
  modified_base (13)..(13): 2'-O-methyluridine-5'-phosphate
  modified_base (15)..(15): 2'-O-methyluridine-5'-phosphate
  modified_base (21)..(21): 2'-deoxy-thymidine-5'-phosphate-phosphorothioate
ugnaacgnacccnanaguutt

---

We claim:

1. A double-stranded ribonucleic acid (dsRNA) for inhibiting the expression of a gene in the Ebola virus in a cell, wherein said dsRNA comprises at least two sequences that are complementary to each other and wherein a sense strand comprises a first sequence, wherein said first sequence is identical to the first 19 nucleotides of SEQ ID NO:9 (UGAUGAAGAUUAAGAAAAA), and an antisense strand comprises a second sequence, wherein said second sequence is identical to the first 19 nucleotides of SEQ ID NO: 10 (UUUUUCUUAAUCUUCAUCA), and wherein said sense strand and said antisense strand are each between 19 and 24 nucleotides in length.

2. The dsRNA of claim 1, wherein said dsRNA comprises at least one modified nucleotide.

3. The dsRNA of claim 2, wherein said modified nucleotide is chosen from the group of: a 2'-0-methyl modified nucleotide, a nucleotide comprising a 5'-phosphorothioate group, and a terminal nucleotide linked to a cholesteryl derivative or dodecanoic acid bisdecylamide group.

4. The dsRNA of claim 2, wherein said modified nucleotide is chosen from the group of: a 2'-deoxy-2'-fluoro modified nucleotide, a 2'-deoxy-modified nucleotide, a locked nucleotide, an abasic nucleotide, 2'-amino-modified nucleotide, 2'-alkyl-modified nucleotide, morpholino nucleotide, a phosphoramidate, and a non-natural base comprising nucleotide.

5. The dsRNA of claim 3, wherein said sense strand consists of SEQ ID NO: 159 and wherein said antisense strand consists of SEQ ID NO: 160.

6. The dsRNA of claim 2, wherein said sense strand consists of SEQ ID NO: 1027 and wherein said antisense strand consists of SEQ ID NO: 1028.

7. A cell comprising the dsRNA of claim 1.

8. A pharmaceutical composition for inhibiting the expression of a gene from an Ebola virus in an organism, comprising a dsRNA of claim 1 and a pharmaceutically acceptable carrier.

9. The pharmaceutical composition of claim 8, wherein said sense strand consists of SEQ ID NO: 159 and wherein said antisense strand consists of SEQ ID NO: 160.

10. The pharmaceutical composition of claim 8, wherein said sense strand consists of SEQ ID NO: 1027 and wherein said antisense strand consists of SEQ ID NO: 1028.

11. A method for inhibiting the expression of a gene from an Ebola virus in a cell, the method comprising:
   (a) introducing into the cell a double-stranded ribonucleic acid (dsRNA) of claim 1; and
   (b) maintaining the cell produced in step (a) for a time sufficient to obtain degradation of the mRNA transcript of a gene from the Ebola virus, thereby inhibiting expression of a gene from the Ebola virus in the cell.

12. A method of treating or managing pathological processes mediated by Ebola expression comprising administering to a patient in need of such treatment or management a therapeutically effective amount of a dsRNA of claim 1.

13. A vector for inhibiting the expression of a gene from the Ebola virus in a cell, said vector comprising a regulatory sequence operably linked to a nucleotide sequence that encodes the dsRNA of claim 1.

14. A cell comprising the vector of claim 13.

15. The dsRNA of claim 1, wherein said dsRNA, upon contact with a cell infected with Ebola virus, inhibits expression of a gene from the virus by at least 40%.

16. The dsRNA of claim 1, wherein said antisense strand comprises a region of complementarity to at least a part of Ebola VP35 mRNA, wherein said region of complementarity is between 19 and 24 nucleotides in length.

17. The vector of claim 13, wherein said dsRNA, upon contact with a cell infected with Ebola virus, inhibits expression of a gene from the virus by at least 40%.

18. A method of increasing life-span of a subject infected with an Ebola virus, comprising administering to the subject a dsRNA of claim 1 in an amount sufficient to increase the life-span of the subject.

19. A method of decreasing viral titre in a subject infected with an Ebola virus, comprising administering to the subject a dsRNA of claim 1 in an amount sufficient to decrease viral titre in the subject.

20. A method of sustaining platelet count in a subject infected with an Ebola virus, comprising administering to the subject a dsRNA of claim 1 in an amount sufficient to sustain platelet count.

21. The method of claim 20, wherein the lymphocyte count of the subject is also sustained.

* * * * *

UNITED STATES PATENT AND TRADEMARK OFFICE
CERTIFICATE OF CORRECTION

PATENT NO. : 7,759,320 B2
APPLICATION NO. : 12/055295
DATED : July 20, 2010
INVENTOR(S) : Sina Bavari et al.

It is certified that error appears in the above-identified patent and that said Letters Patent is hereby corrected as shown below:

Title Page, Item (54) Title: and Col. 1, Line 1-3, please REPLACE the TITLE of the Application with the following CORRECT TITLE:   "Compositions and Methods for Inhibiting Expression of a Gene from the Ebola Virus".

Please CORRECT claim 5 as follows:  "The dsRNA of claim 2 wherein said sense strand consists of SEQ ID NO:159 and wherein said antisense strand consists of SEQ ID NO:160."

Signed and Sealed this

Twenty-sixth Day of October, 2010

David J. Kappos
*Director of the United States Patent and Trademark Office*

UNITED STATES PATENT AND TRADEMARK OFFICE
CERTIFICATE OF CORRECTION

| | | |
|---|---|---|
| PATENT NO. | : 7,759,320 B2 | Page 1 of 1 |
| APPLICATION NO. | : 12/055295 | |
| DATED | : July 20, 2010 | |
| INVENTOR(S) | : Bavari et al. | |

It is certified that error appears in the above-identified patent and that said Letters Patent is hereby corrected as shown below:

Title Pg, Item (73), add Assignee: "The Government of the United States, as represented by the Secretary of the Army".

Signed and Sealed this
Nineteenth Day of April, 2011

David J. Kappos
*Director of the United States Patent and Trademark Office*

UNITED STATES PATENT AND TRADEMARK OFFICE
CERTIFICATE OF CORRECTION

| | | |
|---|---|---|
| PATENT NO. | : 7,759,320 B2 | Page 1 of 1 |
| APPLICATION NO. | : 12/055295 | |
| DATED | : July 20, 2010 | |
| INVENTOR(S) | : Sina Bavari et al. | |

It is certified that error appears in the above-identified patent and that said Letters Patent is hereby corrected as shown below:

At column 1, lines 25-30, please DELETE the paragraph under the heading "Government Support" and REPLACE with the following paragraph:

-- This invention was made with government support under contract number HHSN266200600012C, awarded by the Department of Health and Human Services (DHHS). The government has certain rights in the invention. --

Signed and Sealed this
Twenty-seventh Day of September, 2011

David J. Kappos
*Director of the United States Patent and Trademark Office*